United States Patent 11,446,398 (REGULATED BIOCIRCUIT SYSTEMS) - sequence listing, part 35

SEQ ID NO: 120355 - DNA, 1204 bp, Homo sapiens
  Payload ID: 3597
  Gene Symbol: F11
  Gene Name: coagulation factor XI
  ENST ID: ENST00000492972
  CDS Start-End: 98-586
acacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataatagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagtctaacagaataaaaataaaaacctactctctctctctctaaataacagttccttacctaagacaaaatactcatgtaaaaagtcttatcctgctccatactggattttgaaatatttcaaggataaatctatcacataaggatttaaaaattatctgatctctaataaccaaatctgtgttctcatctttaaaaatttactagggaaatagattattaatttgtatattcagaaatatttgagatgatttagattttcatagtaaactgcatttatctggaatcaaca

SEQ ID NO: 120356 - DNA, 2049 bp, Homo sapiens
  Payload ID: 3598
  Gene Symbol: F12
  Gene Name: coagulation factor XII (Hageman factor)
  Uniprot ID: P00748
  ENST ID: ENST00000253496
  CDS Start-End: 50-1897
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgag

SEQ ID NO: 120357 - DNA, 3999 bp, Homo sapiens
  Payload ID: 3599
  Gene Symbol: F13A1
  Gene Name: coagulation factor XIII, A1 polypeptide
  Uniprot ID: P00488
  ENST ID: ENST00000264870
  CDS Start-End: 267-2465
aagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggctccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 120358 - DNA, 454 bp, Homo sapiens
  Payload ID: 3599
  Gene Symbol: F13A1
  Gene Name: coagulation factor XIII, A1 polypeptide
  ENST ID: ENST00000445223
  CDS Start-End: 1-308
atgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaaca

SEQ ID NO: 120359 - DNA, 631 bp, Homo sapiens
  Payload ID: 3599
  Gene Symbol: F13A1
  Gene Name: coagulation factor XIII, A1 polypeptide
  ENST ID: ENST00000451619
  CDS Start-End: 1-443
ccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtggcaggagctggaatgacatccagcccctgaattaccctgtgctctaagactggtctgtatagtgccaaatattgataacttgggcccacccaaggagaaaatctcatataaataaaagtaaaactggtataa

SEQ ID NO: 120360 - DNA, 582 bp, Homo sapiens
  Payload ID: 3599
  Gene Symbol: F13A1
  Gene Name: coagulation factor XIII, A1 polypeptide
  ENST ID: ENST00000414279
  CDS Start-End: 167-582
aaaggaaaccctcccagaccctctgaccaaaggggacgggtggggacttcctggcactgcagggccccttgcctgtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagaga

SEQ ID NO: 120361 - DNA, 592 bp, Homo sapiens
  Payload ID: 3599
  Gene Symbol: F13A1
  Gene Name: coagulation factor XIII, A1 polypeptide
  ENST ID: ENST00000431222
  CDS Start-End: 36-592
agatctagggatggggatggggaggagaagtgggaatgggaaattgggagtcagaggggcaagtgggagagaagggcgcacctgccgggataacaggccagatgaatccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtgggg

SEQ ID NO: 120362 - DNA, 2217 bp, Homo sapiens
  Payload ID: 3600
  Gene Symbol: F13B
  Gene Name: coagulation factor XIII, B polypeptide
  Uniprot ID: P05160
  ENST ID: ENST00000367412
  CDS Start-End: 45-2030
agtgcttagaattgttaaaatctttgtgaagcacaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcgttatggttgcgcttcagggtacaaaaccactggagggaaggatgaagaagtggttcaatgtctctctgatggatggtcttctcaaccaacctgtaggaaagaacatgaaacatgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaatagaccacacattttgcatggtgaatatattgagtttatttgtagaggagatacttatccagctgaattatatattactggatctatacttagaatgcaatgtgacagagggcagttaaaatatccaagatgtattccaagacaaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcgttatttataaatgaaaaccaataaatgtctaatttttagtttgt

SEQ ID NO: 120363 - DNA, 4789 bp, Homo sapiens
  Payload ID: 3601
  Gene Symbol: COPA
  Gene Name: coatomer protein complex, subunit alpha
  Uniprot ID: P53621
  ENST ID: ENST00000241704
  CDS Start-End: 231-3905
ccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttga

SEQ ID NO: 120364 - DNA, 4664 bp, Homo sapiens
  Payload ID: 3601
  Gene Symbol: COPA
  Gene Name: coatomer protein complex, subunit alpha
  Uniprot ID: P53621
  ENST ID: ENST00000368069
  CDS Start-End: 79-3780
cgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttga

SEQ ID NO: 120365 - DNA, 3481 bp, Homo sapiens
  Payload ID: 3602
  Gene Symbol: COPB1
  Gene Name: coatomer protein complex, subunit beta 1
  Uniprot ID: P53618
  ENST ID: ENST00000249923
  CDS Start-End: 302-3163
agccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccggattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttata

SEQ ID NO: 120366 - DNA, 3382 bp, Homo sapiens
  Payload ID: 3602
  Gene Symbol: COPB1
  Gene Name: coatomer protein complex, subunit beta 1
  Uniprot ID: P53618
  ENST ID: ENST00000439561
  CDS Start-End: 247-3108
aggtggctgtggcttcggtcgttaccccacccccttccacgtcagccaaggactctggagccgccgccgccgctgctgcggttcatagccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaa

SEQ ID NO: 120367 - DNA, 729 bp, Homo sapiens
  Payload ID: 3602
  Gene Symbol: COPB1
  Gene Name: coatomer protein complex, subunit beta 1
  ENST ID: ENST00000529866
  CDS Start-End: 318-729
cttccacgtcagccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccgggtggggattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgc

SEQ ID NO: 120368 - DNA, 1584 bp, Homo sapiens
  Payload ID: 3602
  Gene Symbol: COPB1
  Gene Name: coatomer protein complex, subunit beta 1
  ENST ID: ENST00000534234
  CDS Start-End: 128-1584
atagccggagtagacggagccgcagtagacggatccgcggctgcaccaaaccactgcccctcggagcctgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagaggt

SEQ ID NO: 120369 - DNA, 576 bp, Homo sapiens
  Payload ID: 3602
  Gene Symbol: COPB1
  Gene Name: coatomer protein complex, subunit beta 1
  ENST ID: ENST00000534771
  CDS Start-End: 181-576
aaaatacgtggtttcattgctctgcggcctaatcaaaccctggacaagagaagaggaagaaaataggatatacttgcagcgcgcaagcgctgcacaaagaaagcatgtcctctctgagtcgccattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattg

SEQ ID NO: 120370 - DNA, 3360 bp, Homo sapiens
  Payload ID: 3603
  Gene Symbol: COPB2
  Gene Name: coatomer protein complex, subunit beta 2 (beta prime)
  Uniprot ID: P35606
  ENST ID: ENST00000333188
  CDS Start-End: 183-2903
ggaaacgacggccctgcgcgcagtttgcgcaggcgctccggccctggcctctgactatcgcgagaatcggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatttttcttagagctgaatatccaggctgtaattctctaaa

SEQ ID NO: 120371 - DNA, 3034 bp, Homo sapiens
  Payload ID: 3603
  Gene Symbol: COPB2
  Gene Name: coatomer protein complex, subunit beta 2 (beta prime)
  Uniprot ID: P35606
  ENST ID: ENST00000507777
  CDS Start-End: 131-2764
atcgcgagaatcggctcccggaagttccacgtcagtcagtctgacgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaatt

SEQ ID NO: 120372 - DNA, 635 bp, Homo sapiens
  Payload ID: 3603
  Gene Symbol: COPB2
  Gene Name: coatomer protein complex, subunit beta 2 (beta prime)
  ENST ID: ENST00000514508
  CDS Start-End: 405-635
agaatcggctcccggaagttccacgtcagtcagtctgacggtcagtggatcggtgggtttatctcaaggcctgagtagccggtaacaaacgagggttcccgggattggaccgacgcagccatgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgct

SEQ ID NO: 120373 - DNA, 629 bp, Homo sapiens
  Payload ID: 3603
  Gene Symbol: COPB2
  Gene Name: coatomer protein complex, subunit beta 2 (beta prime)
  ENST ID: ENST00000512153
  CDS Start-End: 297-629
gactatcgcgagaatcggctcccggaagttccacgtcagtcagtctgacggtcagtggatcggtgggtttatctcaaggcctgagtagccggtaacaaacgagggttcccgggattggaccgacgcagccatggtaggtccagatcccgtagaagggagcggggtcccataggttacggccgattcctggagcttctggactgagggccgcgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaagga

SEQ ID NO: 120374 - DNA, 565 bp, Homo sapiens
  Payload ID: 3603
  Gene Symbol: COPB2
  Gene Name: coatomer protein complex, subunit beta 2 (beta prime)
  ENST ID: ENST00000512309
  CDS Start-End: 1-534
tacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtagatttggataatttggaattagaagatattgacacaacagatatcaatctggatgaagatattttggatgattgactgtaatgctttccatttacctgactaaaca

SEQ ID NO: 120375 - DNA, 548 bp, Homo sapiens
  Payload ID: 3603
  Gene Symbol: COPB2
  Gene Name: coatomer protein complex, subunit beta 2 (beta prime)
  ENST ID: ENST00000515006
  CDS Start-End: 91-548
cagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtggacacacccattatgttatgcagattgtgatcaaccccaaagataacaatcagtttgccagtgcctctttggacaggactatcaaggtgtggcagttgggctc

SEQ ID NO: 120376 - DNA, 729 bp, Homo sapiens
  Payload ID: 3603
  Gene Symbol: COPB2
  Gene Name: coatomer protein complex, subunit beta 2 (beta prime)
  ENST ID: ENST00000513274
  CDS Start-End: 462-729
acgtcagtcagtctgacggtcagtggatcggtgggtttatctcaaggcctgagtagccggtaacaaacgagggttcccgggattggaccgacgcagccatggtaggtccagatcccgtagaagggagcggggtcccataggttacggccgattcctggagcttctggactgagggccgcgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtg

SEQ ID NO: 120377 - DNA, 433 bp, Homo sapiens
  Payload ID: 3603
  Gene Symbol: COPB2
  Gene Name: coatomer protein complex, subunit beta 2 (beta prime)
  ENST ID: ENST00000503326
  CDS Start-End: 1-355
ccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagcagcctgatccttggccccttgagccgactggccatctggatggagcacgtgatacagctggaccaagttggttgcatcatcgattctgagaatgaaagggtttaatgttatctaggggttttcttcatttgattcacagtcctataaaagtgtgtgccaacttcaaa

SEQ ID NO: 120378 - DNA, 848 bp, Homo sapiens
  Payload ID: 3603
  Gene Symbol: COPB2
  Gene Name: coatomer protein complex, subunit beta 2 (beta prime)
  ENST ID: ENST00000512242
  CDS Start-End: 590-848
gtggatcggtgggtttatctcaaggcctgagtagccggtaacaaacgagggttcccgggattggaccgacgcagccatggacttcatgaataacacttcttcagaatatttcctgatatgacactattgacctgggcacaaaattgtgatttgtgaatatttaaaattcattggccgggtgcgggggttcacgcctgtaatcctagcactttgggaggccgaggcgggcggatcacaaggtcaggagatcgaaaccatcctggctaacacggtgaaaccctgtctctactgaaaatacaaaaaattagctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaa

SEQ ID NO: 120379 - DNA, 1141 bp, Homo sapiens
  Payload ID: 3604
  Gene Symbol: COPE
  Gene Name: coatomer protein complex, subunit epsilon
  Uniprot ID: O14579
  ENST ID: ENST00000262812
  CDS Start-End: 50-976
tccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 120380 - DNA, 948 bp, Homo sapiens
  Payload ID: 3604
  Gene Symbol: COPE
  Gene Name: coatomer protein complex, subunit epsilon
  Uniprot ID: O14579
  ENST ID: ENST00000349893
  CDS Start-End: 16-786
tgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacc

SEQ ID NO: 120381 - DNA, 907 bp, Homo sapiens
  Payload ID: 3604
  Gene Symbol: COPE
  Gene Name: coatomer protein complex, subunit epsilon
  Uniprot ID: O14579
  ENST ID: ENST00000351079
  CDS Start-End: 28-801
aagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggag

SEQ ID NO: 120382 - DNA, 1144 bp, Homo sapiens
  Payload ID: 3604
  Gene Symbol: COPE
  Gene Name: coatomer protein complex, subunit epsilon
  ENST ID: ENST00000600932
  CDS Start-End: 33-1028
tcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgggtgtcgagtccgggcagggccctccatctggaagcacagcccatggaggctgcttctccagatgggcgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccaccccca

SEQ ID NO: 120383 - DNA, 601 bp, Homo sapiens
  Payload ID: 3604
  Gene Symbol: COPE
  Gene Name: coatomer protein complex, subunit epsilon
  ENST ID: ENST00000593827
  CDS Start-End: 30-470
ggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatc

SEQ ID NO: 120384 - DNA, 1128 bp, Homo sapiens
  Payload ID: 3604
  Gene Symbol: COPE
  Gene Name: coatomer protein complex, subunit epsilon
  ENST ID: ENST00000614388
  CDS Start-End: 41-964
cgtgtctttcaggaagaggagctggtgagaagacagcgaaatggcgcctccggccccggccggcctccggggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctg

SEQ ID NO: 120385 - DNA, 3078 bp, Homo sapiens
  Payload ID: 3605
  Gene Symbol: COPG1
  Gene Name: coatomer protein complex, subunit gamma 1
  Uniprot ID: Q9Y678
  ENST ID: ENST00000314797
  CDS Start-End: 105-2729
agtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaa

SEQ ID NO: 120386 - DNA, 734 bp, Homo sapiens
  Payload ID: 3605
  Gene Symbol: COPG1
  Gene Name: coatomer protein complex, subunit gamma 1
  ENST ID: ENST00000514478
  CDS Start-End: 1-230
agatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgagtcacagttgaggatggatggaccttccttgagctggaaatgaccccgaggcaggagctgctctaagaccaactggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggc

SEQ ID NO: 120387 - DNA, 599 bp, Homo sapiens
  Payload ID: 3605
  Gene Symbol: COPG1
  Gene Name: coatomer protein complex, subunit gamma 1
  ENST ID: ENST00000509889
  CDS Start-End: 1-566
ctataaccgagtggtcttggagcatgaggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttcc

SEQ ID NO: 120388 - DNA, 672 bp, Homo sapiens
  Payload ID: 3605
  Gene Symbol: COPG1
  Gene Name: coatomer protein complex, subunit gamma 1
  ENST ID: ENST00000504350
  CDS Start-End: 58-207
ctccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcaagtgacatttgctcccctctagcttccatcataaatattcaccaccaatgcaactgaaataccaacacattcaaagtgttgttttaaagagcaacacgggagaaaacttgtgcctggaagttttctggaagacaggaaaactttgtttctggagagagcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggt

SEQ ID NO: 120389 - DNA, 3073 bp, Homo sapiens
  Payload ID: 3606
  Gene Symbol: COPG2
  Gene Name: coatomer protein complex, subunit gamma 2
  Uniprot ID: Q9UBF2
  ENST ID: ENST00000330992
  CDS Start-End: 38-2218
ggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcaggtactaaccctcagaagggaggagatacgtgattcagaatgcatttccttgtgagctcttcaactcttcaaatgctcagtttaagaatgtgatgcttttctagaatttaatgatgagtgtttgtgtgtgtgtgtttgtgtgtgtgtgaatatatatatttataaaatggtttactgctgcagaaatattaattttaaaactaaatctctgagtaaaatttgctgaacacttaatcttaaaagagaaactgagtgtgtatagcagtagcacaaaaaggaactcaagctttctgttggaataatgtgaccacttgtgagagttcatatacctggtctcctgtgaagaatcttgaccctcttctcctcaaagtttctatctagttagatagaacttggttatgtagtagattgttggcattttaaaatacatcatttttgaaggtcctgtagcataaggctggtgtctgagagcatgtctcagcctagtgagtagcttagccaaccatgtgtgtccacattaagaagggcttttaattccctccttgacccatatgcagtctttgcagggtggagaaatagcccctaaaagacagccaactagtgccaatagtagtatttacttatttggagacttgggaaggtgaatgtcaagtatttattctacttgattccccccatcatcattttcctccttgatttcttctcttctcatgttcagtgcacaatattcgtaactgttacccagttttcacagaaataagcacacacatcacatttatgttttgaacaacttttactgctcgtaagtacaggagaaacagaagttaaaaaattaacaaatactgggaaagttacagagttacaataaatcataaaagcactagtaaa

SEQ ID NO: 120390 - DNA, 3134 bp, Homo sapiens
  Payload ID: 3606
  Gene Symbol: COPG2
  Gene Name: coatomer protein complex, subunit gamma 2
  Uniprot ID: Q9UBF2
  ENST ID: ENST00000425248
  CDS Start-End: 81-2696
cttcctgcagcctcttccgctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgtttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaaa

SEQ ID NO: 120391 - DNA, 1897 bp, Homo sapiens
  Payload ID: 3607
  Gene Symbol: COPZ1
  Gene Name: coatomer protein complex, subunit zeta 1
  Uniprot ID: P61923
  ENST ID: ENST00000262061
  CDS Start-End: 38-571
ttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaactg

SEQ ID NO: 120392 - DNA, 880 bp, Homo sapiens
  Payload ID: 3607
  Gene Symbol: COPZ1
  Gene Name: coatomer protein complex, subunit zeta 1
  Uniprot ID: P61923
  ENST ID: ENST00000455864
  CDS Start-End: 26-490
acgtcggcaccagctgcggggcaagatggaggcgctgattttgtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctgg

SEQ ID NO: 120393 - DNA, 578 bp, Homo sapiens
  Payload ID: 3607
  Gene Symbol: COPZ1
  Gene Name: coatomer protein complex, subunit zeta 1
  ENST ID: ENST00000551962
  CDS Start-End: 34-357
gcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatct

SEQ ID NO: 120394 - DNA, 1026 bp, Homo sapiens
  Payload ID: 3607
  Gene Symbol: COPZ1
  Gene Name: coatomer protein complex, subunit zeta 1
  ENST ID: ENST00000550171
  CDS Start-End: 26-313
acgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacactgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaaga

SEQ ID NO: 120395 - DNA, 736 bp, Homo sapiens
  Payload ID: 3607
  Gene Symbol: COPZ1
  Gene Name: coatomer protein complex, subunit zeta 1
  ENST ID: ENST00000549116
  CDS Start-End: 21-380
ggcaccagctgcggggcaagatggaggcgctgattttggaaccttccctgtatactgtcaaagccatcctgattctggacaatgatggagatcgactttttgccaagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatg

SEQ ID NO: 120396 - DNA, 575 bp, Homo sapiens
  Payload ID: 3607
  Gene Symbol: COPZ1
  Gene Name: coatomer protein complex, subunit zeta 1
  Uniprot ID: P61923
  ENST ID: ENST00000552362
  CDS Start-End: 26-508
acgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtgctgcagtcagccaaagaacagatcaagtggtcactccttcggtgaagacctcactgttcctggctcttcatcctcttcaaaaaatttgcatgtctgctgtgaattttcatct

SEQ ID NO: 120397 - DNA, 778 bp, Homo sapiens
  Payload ID: 3607
  Gene Symbol: COPZ1
  Gene Name: coatomer protein complex, subunit zeta 1
  ENST ID: ENST00000548753
  CDS Start-End: 346-615
tgatggtttcccaagtttgactctccattgccgattccctgccacattccttcaggaaactgttttgtcttcggtttcctgttaatccctattatataggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacac

SEQ ID NO: 120398 - DNA, 551 bp, Homo sapiens
  Payload ID: 3607
  Gene Symbol: COPZ1
  Gene Name: coatomer protein complex, subunit zeta 1
  ENST ID: ENST00000553231
  CDS Start-End: 26-520
acgtcggcaccagctgcggggcaagatggaggcgctgattttgtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtatacctcttctctcttcatcccctcagtgggtttgaatttttttggaattttccaaacaatctgctagggccttagagagcttcttcccatctctttacccttgggg

SEQ ID NO: 120399 - DNA, 548 bp, Homo sapiens
  Payload ID: 3607
  Gene Symbol: COPZ1
  Gene Name: coatomer protein complex, subunit zeta 1
  ENST ID: ENST00000550713
  CDS Start-End: 134-548
acttaccctgggtctttctcaatgggaaatatcaaaatctgaccaagttgaggtaagggacttacagaggtacctctgtatccccttgcagccccagtgggactaggggaaggtatctggtttaccagtggtgatgggaggcttcaggactgaaggtatgttcgtatctcttcaggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatg

SEQ ID NO: 120400 - DNA, 1462 bp, Homo sapiens
  Payload ID: 3607
  Gene Symbol: COPZ1
  Gene Name: coatomer protein complex, subunit zeta 1
  ENST ID: ENST00000551779
  CDS Start-End: 14-505
gctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtatgactctcccttcttcctttccagatggactgggtcactaaagaggctagaacagcattccacccatacctctcaaatctgagtgaaactagagactcaagacacatcttccttggctccctcttattccagagaactgggactcatacagccagccactccctacccctacttccaactcctttctcagttacctgtgagcagtggctgtcagccttgctctgtacccttcaaaccctccctgcctgcctgatgcctcattcagtgatttattccccagcagaggcttgccttaagcagatggtctgtgtgcatttgtgcacacacactctctttctcttattattcaattgagggctaagctggaaatgcatattctagaatatgcaggttttgcagatccatcttgctaccttgactgcagatagattgtctacctgatgtagggggaagggaggggttccgttttctacccacttggaattctcaccaagaagtccatctggatttgttacccgccccctgcccgccgccccttttaacatatgtccagtaactccctttttttttttcttttataccaggtatacctcttctctcttcatcccctcagtgggtttgaatttttttggaattttccaaacaatctgctagggccttagagagcttcttcccatctctttacccttggggattttctattctccattcttctaaggacagggaagacaagtgaggggaaggagatccccagccctcatccttaccctgccctgtcagcaagctttcctcaatgctgctcttatctctgcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatct

SEQ ID NO: 120401 - DNA, 1232 bp, Homo sapiens
  Payload ID: 3607
  Gene Symbol: COPZ1
  Gene Name: coatomer protein complex, subunit zeta 1
  Uniprot ID: P61923
  ENST ID: ENST00000549043
  CDS Start-End: 96-653
ttgcggctccacgtcggcaccagctgcggggcaagatggaggcgctgattttgccccagtgggactaggggaaggtatctggtttaccagtggtgatgggaggcttcaggactgaaggtatgttcgtatctcttcaggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcata

SEQ ID NO: 120402 - DNA, 797 bp, Homo sapiens
  Payload ID: 3607
  Gene Symbol: COPZ1
  Gene Name: coatomer protein complex, subunit zeta 1
  ENST ID: ENST00000552218
  CDS Start-End: 34-630
gcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgagaacaggaagcacccaggcaggaggactgcatgagtcgagttcaagacaagcttgggcaacacagaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacaccctt

SEQ ID NO: 120403 - DNA, 537 bp, Homo sapiens
  Payload ID: 3607
  Gene Symbol: COPZ1
  Gene Name: coatomer protein complex, subunit zeta 1
  ENST ID: ENST00000552848
  CDS Start-End: 261-537
cttttcagcccaggagtccagccaggtctgcgtttctcccatgcatttgacgaattccaacctgatggtccactcgaatgtgacctttaaactttatacaggttgtcgtcgccttgtgtccccacggctctcctagggacagggaaactgagtcatatcaaggtggaaggcagctgaaggcggggcctaatgggaacgtatggccaatcagcggcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctg

SEQ ID NO: 120404 - DNA, 686 bp, Homo sapiens
  Payload ID: 3608
  Gene Symbol: COPZ2
  Gene Name: coatomer protein complex, subunit zeta 2
  ENST ID: ENST00000581756
  CDS Start-End: 1-425
acaccatcaaggctgttttcatcctagataatgacgggcgccggctgctggccaagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaagtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgccaa

SEQ ID NO: 120405 - DNA, 520 bp, Homo sapiens
  Payload ID: 3608
  Gene Symbol: COPZ2
  Gene Name: coatomer protein complex, subunit zeta 2
  ENST ID: ENST00000583414
  CDS Start-End: 1-138
gacctcttcctatacgtggtgggctcatcctacgagaatgaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgccaa

SEQ ID NO: 120406 - DNA, 157 bp, Homo sapiens
  Payload ID: 3608
  Gene Symbol: COPZ2
  Gene Name: coatomer protein complex, subunit zeta 2
  ENST ID: ENST00000580174
  CDS Start-End: 129-157
ggcaccctgaggatgcagagttcggggatttgcaggaaccttccctctacaccatcaaggctgttttcatcctagataatgacgggcgccggctgctggccaagtattatgatgacacattcccctccatgaaggagcagatggttttcgagaaaaa

SEQ ID NO: 120407 - DNA, 590 bp, Homo sapiens
  Payload ID: 3608
  Gene Symbol: COPZ2
  Gene Name: coatomer protein complex, subunit zeta 2
  ENST ID: ENST00000581637
  CDS Start-End: 1-169
catcaaggctgttttcatcctagataatgacgggcgccggctgctggccaagtattatgatgacacattcccctccatgaaggagcagatggttttcgagaaaaatgtcttcaacaagaccagccggactgagactgatgctcatgtctgttctcacctgcctgtttgagtctctgaaccacatgttaagtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgccaa

SEQ ID NO: 120408 - DNA, 746 bp, Homo sapiens
  Payload ID: 3608
  Gene Symbol: COPZ2
  Gene Name: coatomer protein complex, subunit zeta 2
  ENST ID: ENST00000579263
  CDS Start-End: 1-240
cggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccagcatattcccagggatcccattcccctagcccttccccttactagcgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagataca

SEQ ID NO: 120409 - DNA, 713 bp, Homo sapiens
  Payload ID: 3608
  Gene Symbol: COPZ2
  Gene Name: coatomer protein complex, subunit zeta 2
  ENST ID: ENST00000584955
  CDS Start-End: 1-351
ggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggtctctctgctcagactaatcctgcttgtatggaacttcccgccctggcgctaactcctcgtgctgtggtggccctaccgagatgagcctgtgctgtctcgtgtggagtcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtctt

SEQ ID NO: 120410 - DNA, 895 bp, Homo sapiens
  Payload ID: 3608
  Gene Symbol: COPZ2
  Gene Name: coatomer protein complex, subunit zeta 2
  Uniprot ID: Q9P299
  ENST ID: ENST00000621465
  CDS Start-End: 6-638
gcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctg

SEQ ID NO: 120411 - DNA, 1771 bp, Homo sapiens
  Payload ID: 3609
  Gene Symbol: CBWD1
  Gene Name: COBW domain containing 1
  Uniprot ID: Q9BRT8
  ENST ID: ENST00000314367
  CDS Start-End: 285-1364
gtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaat

SEQ ID NO: 120412 - DNA, 1706 bp, Homo sapiens
  Payload ID: 3609
  Gene Symbol: CBWD1
  Gene Name: COBW domain containing 1
  Uniprot ID: Q9BRT8
  ENST ID: ENST00000356521
  CDS Start-End: 90-1277
ccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattga

SEQ ID NO: 120413 - DNA, 1792 bp, Homo sapiens
  Payload ID: 3609
  Gene Symbol: CBWD1
  Gene Name: COBW domain containing 1
  Uniprot ID: Q9BRT8
  ENST ID: ENST00000377400
  CDS Start-End: 179-1366
aaggggcgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 120414 - DNA, 2513 bp, Homo sapiens
  Payload ID: 3609
  Gene Symbol: CBWD1
  Gene Name: COBW domain containing 1
  ENST ID: ENST00000377447
  CDS Start-End: 57-809
gtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattaggtacgaaatgataagtgtgttaagtgcctacagatccatgttgtatacacagaatattttttactctgattgttgccctgtagaaacttaaggtataaggttgagctgcttcaagaacgttagggaatcacatatattgttgatggctaattgttatataaatggtaatacataaaattagtccccagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctgtcagttcctgtctttactcgtaatgtattctcactctgccaatccctgagttctttcttgttctgctttttttttttttaatttattctatagagcctattctgtctctccccccttcctatgtgaagtcttccctgactcaagtggtctcagttttccctgaactcttgttgacttcatcttccttaactgtcaaccatgccttgtcttccagcttgctttaatatcttctttgtccatagccaaggctgatcagcataggacaatcaggacaatatgaatgatgctcaaatatgtgctaacagtcattttgctgactgttctggagactcccattccttttgaaaacaaagatgggcttttcaaatgaggttatagttcaggggctttgttttgaattattttgtaagacctgaactaataaaagccctatacagagagacattcggtagctattagtattggttatctttaatgtgtacaatgctttgagcgtgatggctcaaaattactattcttagtatttataagttctactgacattagattttgaatctgtcatctcagttcatatagtatatattatcaattgaatcaataaaggtaaggctcattaggagattatttgccatgattaatgattgtggaagaaagaaattcatattttttccacatatttcatcttattttaatagtaatgtccttaaactttactataaaaaaatataatgtctccacgtggagggtaggtattgttgcgtagtgttgaagatcacagaccttggaatctgcttgggttctaatccttggtctgtttctcattgtcttcttagggagcttatttacccttttaaagcctcctctgtaaaaggcataatgcctatcataagtttgctttgagtattacatgagacaatgttggtaaactttgcacagtgctgacacatagtaagtgctctgttagctattattatgtaatttttttcttagcttacatagtaagttcaaggtatagtaaaaaagggaagaaagaaaaagatggctgattttgaaaaggagaaagtgatgaatgaagattgcttttacattttttgacactggtcttctaatcttgtttctcttcataaatcttgtgcaccattgtgattgctaagaagaacacaatctatttagcaaatgtttttggcataaaaggaatgataattattacttgacttttatatccttatagagacctaagctaaatctctgacactgacaatattgactattagccagcttgttaacagtactagaaatgaatttggaagaagcaatttgataaattacacacccttttggcttttaccctccctttatatcagacttgtgactgactcagaatgatatttggggaggtgaaaaaaggtaaacatgtttgagaggaattagccatcagactagagtgtattca

SEQ ID NO: 120415 - DNA, 1807 bp, Homo sapiens
  Payload ID: 3609
  Gene Symbol: CBWD1
  Gene Name: COBW domain containing 1
  ENST ID: ENST00000382389
  CDS Start-End: 261-494
acggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaatcttataaaaaaaataaatgactatcaaaaaagagaaaaaccttacgttatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtctctttagctattatattaaactactatagttaatacattttatcattattttgtatgttggtttttaaaaatttcataaagctataaaaagatacttggtcagataaagtttcctctgcttttaattttgataaagtattatgtatatgatttctttttacctattatatatatgcatctattgttttctcactggtaaatatgggacggacattttgttagaaggttagaagtgagttaaattttcacattcccaagggtacttttgtctcgggttgttgaatatattttaaagtgtttataataatcacttcaaaatatttaggtaattaactgtaaattatgttttggtattctccagggacagtggccttagagctattgagaatttgatgcaaaagaaggggaaatttgattacatactgttagagaccactggattagcagaccctggtaagaagtgagattattaataaccagaatatagttctgtgatatattgtaaatagatgtattagaggaatatctaaaatgaggattaaagcttttgttagtattaaaccaaaaactttttttggttt

SEQ ID NO: 120416 - DNA, 1731 bp, Homo sapiens
  Payload ID: 3609
  Gene Symbol: CBWD1
  Gene Name: COBW domain containing 1
  Uniprot ID: Q9BRT8
  ENST ID: ENST00000382393
  CDS Start-End: 77-418
gctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaatcttataaaaaaaataaatgactatcaaaaaagagaaaaaccttacgttatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtctctttagctattatattaaactactatagttaatacattttatcattattttgtatgttggtttttaaaaatttcataaagctataaaaagatacttggtcagataaagtttcctctgcttttaattttgataaagtattatgtatatgatttctttttacctattatatatatgcatctattgttttctcactggtaaatatgggacggacattttgttagaaggttagaagtgagttaaattttcacattcccaagggtacttttgtctcgggttgttgaatatattttaaagtgtttataataatcacttcaaaatatttaggtaattaactgtaaattatgttttggtattctccagggacagtggccttagagctattgagaatttgatgcaaaagaaggggaaatttgattacatactgttagagaccactggattagcagaccctggtaagaagtgagattattaataaccagaatatagttctgtgatatattgtaaatagatgtattagaggaatatctaaaatgaggattaaagcttttgttagtattaaaccaaaaactttttttggttt

SEQ ID NO: 120417 - DNA, 1241 bp, Homo sapiens
  Payload ID: 3609
  Gene Symbol: CBWD1
  Gene Name: COBW domain containing 1
  Uniprot ID: Q9BRT8
  ENST ID: ENST00000382447
  CDS Start-End: 53-1183
ggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 120418 - DNA, 2182 bp, Homo sapiens
  Payload ID: 3609
  Gene Symbol: CBWD1
  Gene Name: COBW domain containing 1
  ENST ID: ENST00000618061
  CDS Start-End: 1-115
aggtgcagtggcttctatgttttgggttgatgctgaattagggagtgatatttatcttgatggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagatccataaatggactaggacaaatcttagaaacacaaagatcaaggtactttaaaaaagctattcctattaataacaaatcattttagttattaataataaacattaaataattgacaaatatgcttgattctaatataagaaagatctaagtgcatttaaaaagaattggatccaaaatgttgtttggaatgctcttaataagttagtttggcatatttggctagtacatttgcctgtcttcaaaactaagaatacaaagccatgataacactgtgtaagtgtttgcttaatgaggaagaaaagacttccaaacactcgagagggtaactcagtacagaaatctgaagtatattgaggaatcttaatttgaagtgtttaaatggctttttaatatttaaaaagccttcttagtgttttatagttgccaaaaaatacatggagtctttaccttgaagttcctgacaaattcttttattaaattttgactttcattttctctaggttctgttcctaaaacatctgtgaagtgtatttctgtagattaaattctgttttccattgaatgttatcttaatttcagaaaatttctgtgcagggttattttattaagctcatttttttttttttttttttttttttggtgagaaaggctcagcagctaatagactcagcaacaggcagccaggagctctgaggctcacagctggcagtctagttccactcagtctctactggagaaattctttctttggaagtacagcagaggccttaggtgagtggcttgtctgctatggcagagattagaggtgctgccagactgccataagtgttaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcatttcaaattccattgtagaaagtctctgataatctcacttatactatgagccattcctcagtatctgtcctcttcctgttagtgttctacaattcctttctccttaatttttctccgctttacaaaatgtcacacagacaagtgcataatacttaaacaagcttttaaaaataatgctcataaatagctttggttctgtcataatattcgtatttataaacattttaagtcaattctcttcttttgttttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattattcagtgtatggtgcttgccagtgcatctgagaatctagggactttctgaaatagtacttccttgctatgaggactgaagttgcattagaatccttttcaatgaagatcagatgtcctgagtacaattcttactattgggtcctgaatcttacattaaatattctctcaaattccttgaggcatagcaacttgagcttaccagtttagaaactggagatttgggctgggcgcggtggctcacgcctgtaatcccagcactttgggaggccaaggtgggtggatcacgaggtcaggagatggagaccatcctggctaacactgtgaaaccccgtctctactgaaaatacaaaaaattagctgagcctggtggtgggcgcctgtagtcccagctactcaggaggctgaggcaggagaatggcgtgaacccgggaggcggagcttgcagtgagctgagatcgcaccactgcactccagcctgggtgacagagcgagactctgtctcaaaaaaaaaaaaa

SEQ ID NO: 120419 - DNA, 1813 bp, Homo sapiens
  Payload ID: 3609
  Gene Symbol: CBWD1
  Gene Name: COBW domain containing 1
  ENST ID: ENST00000612045
  CDS Start-End: 44-526
gtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtatcataactattgtggattcaaaatatggattaaaagtgaaataccactaaaggcagaaaagaatgaaatcatcccacccactgacccgttcccaatctgagcatatggatagggcccaaagcagcaaagaattggacaacttaaaatgacagctctctattctgaggacttgacacccaggctactgacattgttcttttcagttccacaaatgtgacagcatttaatgcaatagaagcaatgaatgaagttacccagagaagcatttaacagaagagaaacctgatggccttatcaatgaagctactagatccataaatggactaggacaaatcttagaaacacaaagatcaaggctcagcagctaatagactcagcaacaggcagccaggagctctgaggctcacagctggcagtctagttccactcagtctctactggagaaattctttctttggaagtacagcagaggccttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaa

SEQ ID NO: 120420 - DNA, 2391 bp, Homo sapiens
  Payload ID: 3609
  Gene Symbol: CBWD1
  Gene Name: COBW domain containing 1
  ENST ID: ENST00000475990
  CDS Start-End: 1-280
attagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagactttcggacaaagtccttttcttggctgttataaaaactatatttggttttaaacagaaacacttgttttagtacaaatcatctttgtctactttcatttttctttattattttcgtgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacgttacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattcagataaatataatagtttttctttatttcatcattgttcattgattgcaacccatttctaaaacaaattatttaatataaccaaactcctttaacttctcaacttttcccacgaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaagaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctatgatctggaggagactccagtgagctggaaggatgacactgagagaacaaatcgattggtcctccttggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcacgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggtt

SEQ ID NO: 120421 - DNA, 499 bp, Homo sapiens
  Payload ID: 3609
  Gene Symbol: CBWD1
  Gene Name: COBW domain containing 1
  ENST ID: ENST00000616803
  CDS Start-End: 1-153
gagctctatgaagagtggctggaacttagaaacggttgcctctgctgttcagtgaaggacagtggccttagagctattgagaatttgatgcaaaagaaggggaaatttgattacatactgttagagaccactggattagcagaccctgagtgataattcactatttatgattgaatgattatcatattaaagaggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaag

SEQ ID NO: 120422 - DNA, 585 bp, Homo sapiens
  Payload ID: 3609
  Gene Symbol: CBWD1
  Gene Name: COBW domain containing 1
  ENST ID: ENST00000618361
  CDS Start-End: 1-115
aggtgcagtggcttctatgttttgggttgatgctgaattagggagtgatatttatcttgatggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaaggctcagcagctaatagactcagcaacaggcagccaggagctctgaggctcacagctggcagtctagttccactcagtctctactggagaaattctttctttggaagtacagcagaggccttagacagaatctcactctggtttgagacagaatctcactctgtcccccaagttggagtgcggtggtgcgacctcggctcactgaaacctctgcctcct

SEQ ID NO: 120423 - DNA, 1413 bp, Homo sapiens
  Payload ID: 3609
  Gene Symbol: CBWD1
  Gene Name: COBW domain containing 1
  ENST ID: ENST00000613355
  CDS Start-End: 48-224
gttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagactttcggacaaagtccttttcttggctgttataaaaactatatttggttttaaacagaaacacttgttttagtacaaatcatctttgtctactttcatttttctttattattttcgtgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaag

SEQ ID NO: 120424 - DNA, 1585 bp, Homo sapiens
  Payload ID: 3609
  Gene Symbol: CBWD1
  Gene Name: COBW domain containing 1
  ENST ID: ENST00000465014
  CDS Start-End: 74-556
gggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagatccataaatggactaggacaaatcttagaaacacaaagatcaagaatctcactctggtttgagacagaatctcactctgtcccccaagttggagtgcggtggtgcgacctcggctcactgaaacctctgcctcctgggttcaggcgattctcctgcttcaccctccgagtagctgggattacagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggct

SEQ ID NO: 120425 - DNA, 1648 bp, Homo sapiens
  Payload ID: 3609
  Gene Symbol: CBWD1
  Gene Name: COBW domain containing 1
  ENST ID: ENST00000616944
  CDS Start-End: 84-626
gtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagactttcggacaaagtccttttcttggctgttataaaaactatatttggttttaaacagaaacacttgttttagtacaaatcatctttgtctactttcatttttctttattattttcgtgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacgttacttgatatttgggtatttaagtcatgaaaggtatttcttctaggaagcagtgattctaaagtgtatgcttaaccagtcagttgagtgtctactcttgtgtgttcacaagtgtgcac

SEQ ID NO: 120426 - DNA, 1227 bp, Homo sapiens
  Payload ID: 3609
  Gene Symbol: CBWD1
  Gene Name: COBW domain containing 1
  ENST ID: ENST00000619157
  CDS Start-End: 1-85
tgctgaattagggagtgatatttatcttgatggtatcataactattgtggattcaaaatatggattaaaagtgaaataccactaaaggcagaaaagaatgaaatcatcccacccactgacccgttcccaatctgagcatatggatagggcccaaagcacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataa

SEQ ID NO: 120427 - DNA, 1143 bp, Homo sapiens
  Payload ID: 3609
  Gene Symbol: CBWD1
  Gene Name: COBW domain containing 1
  ENST ID: ENST00000613508
  CDS Start-End: 40-1083
cagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtata

SEQ ID NO: 120428 - DNA, 549 bp, Homo sapiens
  Payload ID: 3609
  Gene Symbol: CBWD1
  Gene Name: COBW domain containing 1
  ENST ID: ENST00000489272
  CDS Start-End: 1-58
accactaaaggcagaaaagaatgaaatcatcccacccactgacccgttcccaatctgagcatatggatagggcccaaagcacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaaggtactttaaaaaagctattcctattaataacaaatcattttagttattaataataaacattaaataattgacaaatatgcttgattctaatataagaaagatctaagtgcatttaaaaagaattggatccaaaatgttgtttggaatgctcttaataagttagtttggcatatttggctagtacatttgcctgtcttcaaaactaagaatacaaagccatgataacactgtgtaagtgtttgcttaatgaggaagaaaagacttccaaacactcgagagggtaactcag

SEQ ID NO: 120429 - DNA, 1812 bp, Homo sapiens
  Payload ID: 3610
  Gene Symbol: CBWD2
  Gene Name: COBW domain containing 2
  Uniprot ID: Q8IUF1
  ENST ID: ENST00000259199
  CDS Start-End: 179-1366
aagggacgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacc

SEQ ID NO: 120430 - DNA, 1740 bp, Homo sapiens
  Payload ID: 3610
  Gene Symbol: CBWD2
  Gene Name: COBW domain containing 2
  ENST ID: ENST00000358604
  CDS Start-End: 79-255
gtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacac

SEQ ID NO: 120431 - DNA, 1436 bp, Homo sapiens
  Payload ID: 3610
  Gene Symbol: CBWD2
  Gene Name: COBW domain containing 2
  ENST ID: ENST00000456188
  CDS Start-End: 48-596
gttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaagcaaagaattggacaacttaaaatgacagctctctattctgaggacttgacacccaggctactgacattgttcttttcggttctacaaatgtgacagcatttaatgcaatagaagcaatgaatgaagttacccagagaaggtcaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 120432 - DNA, 1411 bp, Homo sapiens
  Payload ID: 3610
  Gene Symbol: CBWD2
  Gene Name: COBW domain containing 2
  ENST ID: ENST00000433343
  CDS Start-End: 82-624
ggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaagtgaaataccactaaaggcagaagagaatgaaatcatcccacccactgacccgttcccaatctgagcatatggatagggcccaaagcacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactg

SEQ ID NO: 120433 - DNA, 1665 bp, Homo sapiens
  Payload ID: 3610
  Gene Symbol: CBWD2
  Gene Name: COBW domain containing 2
  ENST ID: ENST00000416503
  CDS Start-End: 107-1237
gtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 120434 - DNA, 2165 bp, Homo sapiens
  Payload ID: 3611
  Gene Symbol: CBWD3
  Gene Name: COBW domain containing 3
  Uniprot ID: Q5JTY5
  ENST ID: ENST00000360171
  CDS Start-End: 552-1739
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 120435 - DNA, 1665 bp, Homo sapiens
  Payload ID: 3611
  Gene Symbol: CBWD3
  Gene Name: COBW domain containing 3
  ENST ID: ENST00000377342
  CDS Start-End: 107-1237
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 120436 - DNA, 1813 bp, Homo sapiens
  Payload ID: 3611
  Gene Symbol: CBWD3
  Gene Name: COBW domain containing 3
  ENST ID: ENST00000377344
  CDS Start-End: 44-526
gtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaa

SEQ ID NO: 120437 - DNA, 1403 bp, Homo sapiens
  Payload ID: 3611
  Gene Symbol: CBWD3
  Gene Name: COBW domain containing 3
  ENST ID: ENST00000377349
  CDS Start-End: 88-264
gggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgta

SEQ ID NO: 120438 - DNA, 1736 bp, Homo sapiens
  Payload ID: 3611
  Gene Symbol: CBWD3
  Gene Name: COBW domain containing 3
  ENST ID: ENST00000478048
  CDS Start-End: 77-418
gctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtaagaagtgagattattaataaccagaatatagttctgtgatatattgtaaatagatgtattagaggaatatctaaaatgagtattaaagcttttgttagtattaaaccaaaaactttttttggtttaaaaga

SEQ ID NO: 120439 - DNA, 1771 bp, Homo sapiens
  Payload ID: 3611
  Gene Symbol: CBWD3
  Gene Name: COBW domain containing 3
  ENST ID: ENST00000615061
  CDS Start-End: 79-255
gtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaat

SEQ ID NO: 120440 - DNA, 2437 bp, Homo sapiens
  Payload ID: 3611
  Gene Symbol: CBWD3
  Gene Name: COBW domain containing 3
  ENST ID: ENST00000621396
  CDS Start-End: 82-624
ggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgaggcgtgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgacgatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtata

SEQ ID NO: 120441 - DNA, 1611 bp, Homo sapiens
  Payload ID: 3611
  Gene Symbol: CBWD3
  Gene Name: COBW domain containing 3
  ENST ID: ENST00000618217
  CDS Start-End: 144-1187
atccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtt

SEQ ID NO: 120442 - DNA, 1648 bp, Homo sapiens
  Payload ID: 3611
  Gene Symbol: CBWD3
  Gene Name: COBW domain containing 3
  ENST ID: ENST00000621474
  CDS Start-End: 84-626
gtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcac

SEQ ID NO: 120443 - DNA, 1440 bp, Homo sapiens
  Payload ID: 3611
  Gene Symbol: CBWD3
  Gene Name: COBW domain containing 3
  ENST ID: ENST00000612050
  CDS Start-End: 48-596
gttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaaggtcaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtata

SEQ ID NO: 120444 - DNA, 1413 bp, Homo sapiens
  Payload ID: 3611
  Gene Symbol: CBWD3
  Gene Name: COBW domain containing 3
  ENST ID: ENST00000622755
  CDS Start-End: 48-224
gttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaag

SEQ ID NO: 120445 - DNA, 1381 bp, Homo sapiens
  Payload ID: 3611
  Gene Symbol: CBWD3
  Gene Name: COBW domain containing 3
  ENST ID: ENST00000611426
  CDS Start-End: 120-296
gcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaaggtactttaaaaaagctattcctattaataacaaatcattttagttattaataataaacattaagtaattgacaaatatgcttgattctgatataagaaagatctaagtgcatttaaaaagatttggatccaaaatgttgtttggaatgctcttaataagttagtttggcatatttgactagtacatttgcctgtcttcaaaactaagattacaaagccatgataacactgtgtaagtgtttgcttaatgaggaagaaaagacttccaaacactcgagagggtaactcagtacagaaatctgaagtatattgaggaatcttaatttgaagtgtttaaatggctttttaatatttaaaaagccttcttagtgttttatagttgccaaaaaatacatggagtctttaccttgaagttcctgacaaattcttttattaaattttgactttcattttctcta

SEQ ID NO: 120446 - DNA, 721 bp, Homo sapiens
  Payload ID: 3611
  Gene Symbol: CBWD3
  Gene Name: COBW domain containing 3
  ENST ID: ENST00000616550
  CDS Start-End: 179-721
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagtgaaataccactaa

SEQ ID NO: 120447 - DNA, 1347 bp, Homo sapiens
  Payload ID: 3612
  Gene Symbol: CBWD5
  Gene Name: COBW domain containing 5
  ENST ID: ENST00000377384
  CDS Start-End: 103-444
ggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgttcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaacaatttcataaagctataaaaagatacttggtcagataaagtttcctctgcttttaattttaataaagtattattatgtatatgatttctttttacctattatatata

SEQ ID NO: 120448 - DNA, 1483 bp, Homo sapiens
  Payload ID: 3612
  Gene Symbol: CBWD5
  Gene Name: COBW domain containing 5
  ENST ID: ENST00000377389
  CDS Start-End: 141-317
cgggcgggatcagctagcgtcgcgatgtgatgacgtcaggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcaaaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggt

SEQ ID NO: 120449 - DNA, 2863 bp, Homo sapiens
  Payload ID: 3612
  Gene Symbol: CBWD5
  Gene Name: COBW domain containing 5
  ENST ID: ENST00000377392
  CDS Start-End: 1909-2439
atccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagaacaataaacatgcagtgattgatttttcttacttcaagtggatgagtgagcaagtgactaaaatcttctgtgaattcttcagtgtatggttcttgccaatgcatctgagaatctagggactttctgaaatagtacttccttgctatgaggactgaagttggattagaatccgtttcaatgaagatcagatgtcctgagtagaattcttactattgggtcctgaatcttacattaaatattctctcaaattccttgaggcatgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcatgtgaagatcagggtcctagagtaacctaatattttgtacattggttatttgactcctcatttttatattaaatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattggaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgtt

SEQ ID NO: 120450 - DNA, 1143 bp, Homo sapiens
  Payload ID: 3612
  Gene Symbol: CBWD5
  Gene Name: COBW domain containing 5
  Uniprot ID: Q5RIA9
  ENST ID: ENST00000377395
  CDS Start-End: 40-1083
cagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtata

SEQ ID NO: 120451 - DNA, 1791 bp, Homo sapiens
  Payload ID: 3612
  Gene Symbol: CBWD5
  Gene Name: COBW domain containing 5
  Uniprot ID: Q5RIA9
  ENST ID: ENST00000382405
  CDS Start-End: 179-1366
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgtta

SEQ ID NO: 120452 - DNA, 1242 bp, Homo sapiens
  Payload ID: 3612
  Gene Symbol: CBWD5
  Gene Name: COBW domain containing 5
  ENST ID: ENST00000430059
  CDS Start-End: 54-1184
cggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggta

SEQ ID NO: 120453 - DNA, 1234 bp, Homo sapiens
  Payload ID: 3612
  Gene Symbol: CBWD5
  Gene Name: COBW domain containing 5
  ENST ID: ENST00000429800
  CDS Start-End: 50-1177
gtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggt

SEQ ID NO: 120454 - DNA, 587 bp, Homo sapiens
  Payload ID: 3612
  Gene Symbol: CBWD5
  Gene Name: COBW domain containing 5
  ENST ID: ENST00000489273
  CDS Start-End: 1-532
aacagacttggttccagaagaagatgtaaagaaattaagaacgacaattagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgg

SEQ ID NO: 120455 - DNA, 1413 bp, Homo sapiens
  Payload ID: 3612
  Gene Symbol: CBWD5
  Gene Name: COBW domain containing 5
  ENST ID: ENST00000465474
  CDS Start-End: 48-224
gttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcaaaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaag

SEQ ID NO: 120456 - DNA, 1583 bp, Homo sapiens
  Payload ID: 3612
  Gene Symbol: CBWD5
  Gene Name: COBW domain containing 5
  ENST ID: ENST00000480229
  CDS Start-End: 72-554
gcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactagatccataaatggactaggacaaatcttagaaacacaaagatcaagaatctcactctggtttgagacagaatctcactgtgtcccccaagttggagtgcggtggtgcgatctcggctcactgaaaccactgcctcctgggttcaagcgattctcctgcttcaccctccgagtagctgggattacagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggct

SEQ ID NO: 120457 - DNA, 1411 bp, Homo sapiens
  Payload ID: 3612
  Gene Symbol: CBWD5
  Gene Name: COBW domain containing 5
  ENST ID: ENST00000497250
  CDS Start-End: 82-624
ggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactg

SEQ ID NO: 120458 - DNA, 1648 bp, Homo sapiens
  Payload ID: 3612
  Gene Symbol: CBWD5
  Gene Name: COBW domain containing 5
  ENST ID: ENST00000476161
  CDS Start-End: 84-626
gtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtacac

SEQ ID NO: 120459 - DNA, 1436 bp, Homo sapiens
  Payload ID: 3612
  Gene Symbol: CBWD5
  Gene Name: COBW domain containing 5
  ENST ID: ENST00000486221
  CDS Start-End: 48-596
gttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaaggtcaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 120460 - DNA, 1381 bp, Homo sapiens
  Payload ID: 3612
  Gene Symbol: CBWD5
  Gene Name: COBW domain containing 5
  ENST ID: ENST00000469921
  CDS Start-End: 120-296
gcgatgtgatgacgtcaggccccggccaggccgggagtggcgtgctgggcgtgcgcggctgcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcaaaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaaggtactttaaaaaagctattcctattaataacaaatcattttagttattaataataaacattaagtaattgacaaatatgcttgattctgatataagaaagatctaagttcatttaaaaagaattggatccaaaatgttgtttggaatgctcttaataagttagtttggcatatttggctagtacatttgcctgtcttcaaaactaagattacaaagccatggtaacactgtgtaagtgtttgcttaatgaggaagaaaagacttccaaacactcgagagggtaactcagtacagaaatctgaagtatattgaggaatcttaatttgaagtgtttaaatggcattttaatatttaaaaagccttcttagtgttttatagttgccaaaaaatacatggagtctttaccttgaagttcctgacaaattcttttattaaattttgactttcattttctcta

SEQ ID NO: 120461 - DNA, 1792 bp, Homo sapiens
  Payload ID: 3613
  Gene Symbol: CBWD7
  Gene Name: COBW domain containing 7
  Uniprot ID: A6NM15
  ENST ID: ENST00000377391
  CDS Start-End: 179-1366
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 120462 - DNA, 1608 bp, Homo sapiens
  Payload ID: 3613
  Gene Symbol: CBWD7
  Gene Name: COBW domain containing 7
  ENST ID: ENST00000456520
  CDS Start-End: 53-1183
ggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 120463 - DNA, 452 bp, Homo sapiens
  Payload ID: 3613
  Gene Symbol: CBWD7
  Gene Name: COBW domain containing 7
  ENST ID: ENST00000620776
  CDS Start-End: 1-222
tgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggtcccagaagaagatgta

SEQ ID NO: 120464 - DNA, 599 bp, Homo sapiens
  Payload ID: 3613
  Gene Symbol: CBWD7
  Gene Name: COBW domain containing 7
  ENST ID: ENST00000467791
  CDS Start-End: 1-140
ccactggattagcagaccctggtgcagtggcttctatgttttgggttgatgccgaattagggagtgatatttaccttgatggtatcataactattgtggattcaaaatatggattaaaagcaaagaattggacaacttaaaatgacagctctctattctgaggacttgacacccgggctactgacattgttcttttcagttctacaaatgtgacagcatttaatgcaatagaagcaatgaatgaagttacccagagaaggtcaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtagttgatctctctaatgtattagatcttcatgcctttgatagtctctctggaataagtttgcagaaaaaact

SEQ ID NO: 120465 - DNA, 2433 bp, Homo sapiens
  Payload ID: 3613
  Gene Symbol: CBWD7
  Gene Name: COBW domain containing 7
  ENST ID: ENST00000486387
  CDS Start-End: 82-624
ggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgaggcgtgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaagtaattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcagcattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 120466 - DNA, 721 bp, Homo sapiens
  Payload ID: 3613
  Gene Symbol: CBWD7
  Gene Name: COBW domain containing 7
  ENST ID: ENST00000617933
  CDS Start-End: 179-721
aagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaa

SEQ ID NO: 120467 - DNA, 1820 bp, Homo sapiens
  Payload ID: 3613
  Gene Symbol: CBWD7
  Gene Name: COBW domain containing 7
  ENST ID: ENST00000613716
  CDS Start-End: 313-1392
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 120468 - DNA, 1554 bp, Homo sapiens
  Payload ID: 3613
  Gene Symbol: CBWD7
  Gene Name: COBW domain containing 7
  ENST ID: ENST00000382436
  CDS Start-End: 1-412
cacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgccgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataa

SEQ ID NO: 120469 - DNA, 1813 bp, Homo sapiens
  Payload ID: 3613
  Gene Symbol: CBWD7
  Gene Name: COBW domain containing 7
  ENST ID: ENST00000494538
  CDS Start-End: 44-526
gtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatacaatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaa

SEQ ID NO: 120470 - DNA, 2397 bp, Homo sapiens
  Payload ID: 3614
  Gene Symbol: COCH
  Gene Name: cochlin
  Uniprot ID: O43405
  ENST ID: ENST00000216361
  CDS Start-End: 397-2049
gggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaa

SEQ ID NO: 120471 - DNA, 2536 bp, Homo sapiens
  Payload ID: 3614
  Gene Symbol: COCH
  Gene Name: cochlin
  Uniprot ID: O43405
  ENST ID: ENST00000396618
  CDS Start-End: 57-1709
gcactcgggcgcagccgggtggatctcgagcaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaa

SEQ ID NO: 120472 - DNA, 1997 bp, Homo sapiens
  Payload ID: 3614
  Gene Symbol: COCH
  Gene Name: cochlin
  Uniprot ID: O43405
  ENST ID: ENST00000475087
  CDS Start-End: 368-1852
gccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcagcaaaataagtttaaaagggaatctgtggcattcaaccgataaacagaagatcactaagagatgaaaaaaagctactcttggagctcacttcccccaacaagagcaccacattcctaacccctaaggcagcacacagagtccaaaaaaaaaaaa

SEQ ID NO: 120473 - DNA, 654 bp, Homo sapiens
  Payload ID: 3614
  Gene Symbol: COCH
  Gene Name: cochlin
  ENST ID: ENST00000557065
  CDS Start-End: 1-168
cccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacagaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagaga

SEQ ID NO: 120474 - DNA, 2688 bp, Homo sapiens
  Payload ID: 3614
  Gene Symbol: COCH
  Gene Name: cochlin
  ENST ID: ENST00000460581
  CDS Start-End: 547-1863
gacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcagctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgt

SEQ ID NO: 120475 - DNA, 2129 bp, Homo sapiens
  Payload ID: 3614
  Gene Symbol: COCH
  Gene Name: cochlin
  ENST ID: ENST00000468826
  CDS Start-End: 1-1304
attgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacagatataacattggagaagtatctctttgtaatgctaaaaagaagtgaaaatcaacagacttatctaatgaatgcagatgtggcagaaagaatgagtagcactaccgttgactctgaagagagacttcttagaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgt

SEQ ID NO: 120476 - DNA, 554 bp, Homo sapiens
  Payload ID: 3614
  Gene Symbol: COCH
  Gene Name: cochlin
  ENST ID: ENST00000553772
  CDS Start-End: 57-299
gcactcgggcgcagccgggtggatctcgagcaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccat

SEQ ID NO: 120477 - DNA, 775 bp, Homo sapiens
  Payload ID: 3614
  Gene Symbol: COCH
  Gene Name: cochlin
  ENST ID: ENST00000556908
  CDS Start-End: 195-775
gccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccag

SEQ ID NO: 120478 - DNA, 782 bp, Homo sapiens
  Payload ID: 3614
  Gene Symbol: COCH
  Gene Name: cochlin
  ENST ID: ENST00000555881
  CDS Start-End: 177-782
agacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaag

SEQ ID NO: 120479 - DNA, 4637 bp, Homo sapiens
  Payload ID: 3615
  Gene Symbol: CDAN1
  Gene Name: codanin 1
  Uniprot ID: Q8IWY9
  ENST ID: ENST00000356231
  CDS Start-End: 25-3708
tcgccccagagcgccccgaccgggatggcggccgttttggagtcgctgctgcgagaagaggtgtcggtcgcagccgtcgtgcggtggatcgcgcgcagcacccagggttcggaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacagggacgaagccttctcgcaggatcaacccaactccggtgagcgaagagcggtcactctccaagcccaagacctgcttcacctcacccccaatcagctgtgtccccagttcccaaccctcagccctggacactagcccttggggccttggccttcccccagggtgcagaagtctgcaagaggagcgagagatgctcaggaaggagcgctctaagcagctgcagcagtcacctacccccacctgtcccaccccagaattggggtcgcccctccccagccggacaggaagcctcacagatgaacctgcagaccctgccagagtgtcttcccgccagcgcctggagcttgtagcccttgtttactcctcgtgcattgctgagaacctggtaccaaacctcttcttggagcttttcttcgtctttcagctcctcactgcccggaggatggtgactgccaaggacagcgaccctgaactaagtccagctgtcctagattccctggaaagtccactgttccaaagcatccacgattgtgtcttctttgcagtgcaggttttggagtgtcactttcaggttctttccaacctggacaaagggaccttgaagctgctggctgagaatgagcggctgctgtgcttctcaccagctctgcaaggccgccttcgagctgcctatgagggcagtgttgccaaggtctctctggtgatgcctccctctactcaagctgtctcctttcagccagagactgacaatcgtgccaacttctccagtgaccgagcctttcatacttttaagaaacagagggatgtgttttatgaggtgctgcgagagtgggaagatcaccatgaggagcctggctgggattttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaa

SEQ ID NO: 120480 - DNA, 2562 bp, Homo sapiens
  Payload ID: 3615
  Gene Symbol: CDAN1
  Gene Name: codanin 1
  ENST ID: ENST00000562465
  CDS Start-End: 1-1044
gtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaa

SEQ ID NO: 120481 - DNA, 285 bp, Homo sapiens
  Payload ID: 3615
  Gene Symbol: CDAN1
  Gene Name: codanin 1
  ENST ID: ENST00000563260
  CDS Start-End: 1-285
gccgtcgtgcggtggatcgcgcgcagcacccagggttcggaggtaacagcggtgacacgcccccaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccg

SEQ ID NO: 120482 - DNA, 1652 bp, Homo sapiens
  Payload ID: 3616
  Gene Symbol: COQ10A
  Gene Name: coenzyme Q10A
  Uniprot ID: Q96MF6
  ENST ID: ENST00000308197
  CDS Start-End: 262-1005
ccttccttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 120483 - DNA, 1410 bp, Homo sapiens
  Payload ID: 3616
  Gene Symbol: COQ10A
  Gene Name: coenzyme Q10A
  Uniprot ID: Q96MF6
  ENST ID: ENST00000433805
  CDS Start-End: 114-761
gggggtcgctgcgaaccccggggttccgcggtggaggggtgctatactgggatgcaggcgcggcggggactggcagcaatcatgccctgggagctaacgtagagctttggataatgcttttgcaagttgtacgagaagggaagttctcggggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaa

SEQ ID NO: 120484 - DNA, 1369 bp, Homo sapiens
  Payload ID: 3616
  Gene Symbol: COQ10A
  Gene Name: coenzyme Q10A
  Uniprot ID: Q96MF6
  ENST ID: ENST00000546544
  CDS Start-End: 30-722
aaagcttgtttggacgaccttcgtctgggatgcactcttcttctccttcacctacaaatgatagaggattacgaagaactatacggttggctcctctttcctttggccttaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 120485 - DNA, 793 bp, Homo sapiens
  Payload ID: 3616
  Gene Symbol: COQ10A
  Gene Name: coenzyme Q10A
  ENST ID: ENST00000553234
  CDS Start-End: 1-461
gacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgat

SEQ ID NO: 120486 - DNA, 410 bp, Homo sapiens
  Payload ID: 3616
  Gene Symbol: COQ10A
  Gene Name: coenzyme Q10A
  ENST ID: ENST00000551814
  CDS Start-End: 1-194
ctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaagg

SEQ ID NO: 120487 - DNA, 2239 bp, Homo sapiens
  Payload ID: 3617
  Gene Symbol: COQ10B
  Gene Name: coenzyme Q10B
  Uniprot ID: Q9H8M1
  ENST ID: ENST00000263960
  CDS Start-End: 139-855
aagaaggggcgtgtcaggctgcgcaggcggccagtccattggctggaagagaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagt

SEQ ID NO: 120488 - DNA, 879 bp, Homo sapiens
  Payload ID: 3617
  Gene Symbol: COQ10B
  Gene Name: coenzyme Q10B
  ENST ID: ENST00000409398
  CDS Start-End: 69-635
cccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatc

SEQ ID NO: 120489 - DNA, 1355 bp, Homo sapiens
  Payload ID: 3617
  Gene Symbol: COQ10B
  Gene Name: coenzyme Q10B
  ENST ID: ENST00000409010
  CDS Start-End: 237-869
ttttttttgcgtttggcatctgagggactcaagagcggcgcgcatcaccttgggcccaaggctgtgttcgtggctcgtttgcctcgtgagaggcggtgaatcatcggcgaagcgactttggaagcaatttggccattggtgcctttgggctcttccggtctcctcccctatggcttgttgctactgctgttggaaagttttaactttgcgcagaagggttgccggctgctggctgtatgggagtttgtgtttggcgatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctggg

SEQ ID NO: 120490 - DNA, 1641 bp, Homo sapiens
  Payload ID: 3618
  Gene Symbol: COQ2
  Gene Name: coenzyme Q2 4-hydroxybenzoate polyprenyltransferase
  Uniprot ID: Q96H96
  ENST ID: ENST00000311469
  CDS Start-End: 1-1266
atgaccccaatttcacaagtaaggatgaggaaaggttctgcccacaccgccgcccagcctggcagactaggattgcatcctgcgggtgccactgcgcatgcctgccggggaatgacgtcaatccgagctcgtcccggcctcaccagcgccatgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaa

SEQ ID NO: 120491 - DNA, 1464 bp, Homo sapiens
  Payload ID: 3618
  Gene Symbol: COQ2
  Gene Name: coenzyme Q2 4-hydroxybenzoate polyprenyltransferase
  ENST ID: ENST00000311461
  CDS Start-End: 2-988
catgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaaggtatattattttttaaaaataatataggcctaaatccaaattttcccatctgattttcctggaattacttctgattcatgtctggaaaaatttcagtgatatctgaagcttgtggtttgagttgaattactctaaaagcaaactgacagataaagcttttaaaaaaaaatctgggtttctagtgatggttagtagactaattattcataaatttggtttctgctggcataaagaccaaggacagataagacatgaaatgcggaacatgtcaaagttctgccagtagagagcaggaagctgtcatttcaggatattcacccacaccacatcccctacctgtcagaaacttatgttgagaatctacattgttgacttgtaaatgaatgaactaaa

SEQ ID NO: 120492 - DNA, 1304 bp, Homo sapiens
  Payload ID: 3618
  Gene Symbol: COQ2
  Gene Name: coenzyme Q2 4-hydroxybenzoate polyprenyltransferase
  ENST ID: ENST00000503391
  CDS Start-End: 32-673
aatccgagctcgtcccggcctcaccagcgccatgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatacgaccctatattttaaaatgcttaaaacatcttaacccattgcactggttccaattaaagaaggagcacttggtgggtgccagtggagcaggagctgtgaatgccagtcacagccacagcttgccagggttggaatctgctttaacacctatcagttgggtgatcttgggcaagttccctgacctctctgtggctcactcggggataatcataatacctttctcatgcatttcaaaattttctgtcttcccctgcgaatggagatttcatggtaagtgggaccttgtttgtcttattcattgaaatatccccaatataccatatcacaagggctgcctctccctcttcccggatttctttgctaaattgtttaatgcctctacctgatttttataatctggcctcaccctaatgtttcctccaactgaaagtacaccctccaccctctgggtg

SEQ ID NO: 120493 - DNA, 1301 bp, Homo sapiens
  Payload ID: 3618
  Gene Symbol: COQ2
  Gene Name: coenzyme Q2 4-hydroxybenzoate polyprenyltransferase
  ENST ID: ENST00000503915
  CDS Start-End: 1-678
ggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaa

SEQ ID NO: 120494 - DNA, 1335 bp, Homo sapiens
  Payload ID: 3619
  Gene Symbol: COQ3
  Gene Name: coenzyme Q3 methyltransferase
  Uniprot ID: Q9NZJ6
  ENST ID: ENST00000254759
  CDS Start-End: 26-1135
aaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaagtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagatat

SEQ ID NO: 120495 - DNA, 646 bp, Homo sapiens
  Payload ID: 3619
  Gene Symbol: COQ3
  Gene Name: coenzyme Q3 methyltransferase
  ENST ID: ENST00000369240
  CDS Start-End: 25-450
cagccaggaaaacctttgttggggatgaagattcttgacgttggctgtggtggtgggctgttaactgaacccggtggttctttattcattactacaatcaacaaaacacaactttcctatgccttgggaattgttttttcagagcaaattgcaagtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaag

SEQ ID NO: 120496 - DNA, 1182 bp, Homo sapiens
  Payload ID: 3619
  Gene Symbol: COQ3
  Gene Name: coenzyme Q3 methyltransferase
  ENST ID: ENST00000369242
  CDS Start-End: 148-1080
cgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatgttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaagtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagcttatgctgtgaaatccagggtccaggaacacccagcctctgctgagtttgttttaaagggagaaacagaagagctccaagctaatgcctgcaccaatccagctgtgcatgaaaagctgaagaaatgaattgtttctgagaactatagtaatatggcttggatatctgatgttttcaaatacaaaaatgtacaatttatcctttgagagagaatcatgaagaaaagaagg

SEQ ID NO: 120497 - DNA, 1548 bp, Homo sapiens
  Payload ID: 3620
  Gene Symbol: COQ4
  Gene Name: coenzyme Q4
  Uniprot ID: Q9Y3A0
  ENST ID: ENST00000300452
  CDS Start-End: 324-1121
gggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtcaa

SEQ ID NO: 120498 - DNA, 928 bp, Homo sapiens
  Payload ID: 3620
  Gene Symbol: COQ4
  Gene Name: coenzyme Q4
  ENST ID: ENST00000372875
  CDS Start-End: 8-463
cgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacgtgagttttcagctcctgtgtatctggcagtcaccagacaggacagaggaatagcacaggcatgacaccctgaggaaagaggagccctgagctgccaccattggcaggagtgctcttcaggctcatgccaaggctttgtcattttctatgggataggcaaatgggtgggaacatgcctgcaattgataatactggccagtgttcattaacctcgcactgcatgcctgatgccagcctcatccgtgatcttgctgaatccccccacaactctgtcaagtatgttctattattatcctcttttagcagataaggaaacagaggctcagagcagtgaagcaaacttgctaattccacataactggtattaatggagatagtaatcaatcccagatcatgctcttcactgctgtactgtatccctttattccagggacattgctttccctacggtatggcaggtgtggcactctccagcccctccagccccaggcagggaggacaaggagagggggaaagggg

SEQ ID NO: 120499 - DNA, 781 bp, Homo sapiens
  Payload ID: 3620
  Gene Symbol: COQ4
  Gene Name: coenzyme Q4
  ENST ID: ENST00000608951
  CDS Start-End: 278-568
gcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacgattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaa

SEQ ID NO: 120500 - DNA, 956 bp, Homo sapiens
  Payload ID: 3620
  Gene Symbol: COQ4
  Gene Name: coenzyme Q4
  ENST ID: ENST00000609948
  CDS Start-End: 316-576
cggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaaca

SEQ ID NO: 120501 - DNA, 1535 bp, Homo sapiens
  Payload ID: 3621
  Gene Symbol: COQ5
  Gene Name: coenzyme Q5, methyltransferase
  Uniprot ID: Q5HYK3
  ENST ID: ENST00000288532
  CDS Start-End: 42-1025
aacaaggcgtactctctggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctcccagaggcatttggtctgtatctttgctcaactgctaatttctcttggctgtagggtgtgtggttaaggtacaaccacccctaaagctcagttttgaagtgagtgtatttatagcttctctgctggtgctgccttctagagggatgatagatcatttgaacccaatgacaatttttaaccagaaaatttaattgtacctgaatcaacctttcagcctaggacgaagtctaggcccaagtcagagtattaatgatcatgagaattgtgtgctgaaccagtaaacgagtttaccttttgatggta

SEQ ID NO: 120502 - DNA, 992 bp, Homo sapiens
  Payload ID: 3621
  Gene Symbol: COQ5
  Gene Name: coenzyme Q5, methyltransferase
  ENST ID: ENST00000445328
  CDS Start-End: 21-782
gttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcaggaagagttcaaggacatgatagaagatgcaggctttcacaaggtgacttacgaaagtctaacatcaggcattgtggccattcattctggcttcaaactttaattcctttcctatcatggagcatgaaccagtcatatcctgttgaaagcctggaactgaaggataatctggcaaatgagacagcagcagagcatctcctcttaaggatacgtgccttggactcatgtttgaatcgaacagtctcaaagtggaagaacaaattcttgtcacttttttacagctttctttggagctgcttcagtccatctccca

SEQ ID NO: 120503 - DNA, 972 bp, Homo sapiens
  Payload ID: 3621
  Gene Symbol: COQ5
  Gene Name: coenzyme Q5, methyltransferase
  ENST ID: ENST00000552443
  CDS Start-End: 333-972
tggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagaactcctttaatgtgaaagtttttgctggcatcacttcttctgggacatcttcaacctttttgtcacagctccatttcttgttcatgttgtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgatcaggcactccaggaagctcatcgggtgctgaaaccaggaggacggtttctctgtctggaatttagccaagtgaacaatcccctcatatccaggctttatgatctatatagcttccaggtcatccctgtcctgggagaggtcatcgctggagactggaagtcctatcagtaccttgtagagagtatccgaaggtttccgtctcagg

SEQ ID NO: 120504 - DNA, 552 bp, Homo sapiens
  Payload ID: 3621
  Gene Symbol: COQ5
  Gene Name: coenzyme Q5, methyltransferase
  ENST ID: ENST00000547943
  CDS Start-End: 25-552
ggccgttgtcactcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatatttacaccattgcctttgggatccggaatgtcacacacattgat

SEQ ID NO: 120505 - DNA, 574 bp, Homo sapiens
  Payload ID: 3621
  Gene Symbol: COQ5
  Gene Name: coenzyme Q5, methyltransferase
  ENST ID: ENST00000547736
  CDS Start-End: 301-574
actcgactaccaagatggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagaactcctttaatgtgaaagtttttgctggcatcacttcttctgggacatcttcaacctttttgtcacagctccatttcttgttcatgttgagtctctctctgtcgcccaggctggaatgcagtggtccaatttcagctcactgcaacctctaccttccaggttccagtgattctcctgccccaaccacccgagtagctgggattacagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacag

SEQ ID NO: 120506 - DNA, 560 bp, Homo sapiens
  Payload ID: 3621
  Gene Symbol: COQ5
  Gene Name: coenzyme Q5, methyltransferase
  ENST ID: ENST00000551769
  CDS Start-End: 169-560
gtctccgacacagcaacggatactcgcccctgggccgaggccgacctgctccgggaatggcgacgagtcgccaaacagcatctcaaagaacccggatggactgtatatatagtggagagggggtgagtctatcaggtgtttgaaagtgtggctaagaagtatgatgtgatgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtcccagcatcagagaaaacagaagaggcagttaagggcccaacaaaatttatcctgggaagaaattgccaaagagtaccagaatgaagaagattccttgggcgggtctcgtgtcgtggtgtgtgacatcaacaaggagatgctaaaggttggaaagcagaaagccttggctcaaggatacagagctggacttgcatgggtattaggagatgctgaagaactgccctttgatgatgacaagtttgatat

SEQ ID NO: 120507 - DNA, 1520 bp, Homo sapiens
  Payload ID: 3622
  Gene Symbol: COQ6
  Gene Name: coenzyme Q6 monooxygenase
  ENST ID: ENST00000238709
  CDS Start-End: 8-1411
ctgcaccatggcggcccggcttgtcagccgatgcggggctgtgcgtgcagctccccacagcggcccgctggtgctggcgcaggtggtccggcgctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacatt

SEQ ID NO: 120508 - DNA, 2118 bp, Homo sapiens
  Payload ID: 3622
  Gene Symbol: COQ6
  Gene Name: coenzyme Q6 monooxygenase
  Uniprot ID: Q9Y2Z9
  ENST ID: ENST00000334571
  CDS Start-End: 41-1447
gcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatt

SEQ ID NO: 120509 - DNA, 1608 bp, Homo sapiens
  Payload ID: 3622
  Gene Symbol: COQ6
  Gene Name: coenzyme Q6 monooxygenase
  Uniprot ID: Q9Y2Z9
  ENST ID: ENST00000394026
  CDS Start-End: 168-1499
cctctccgggattcctttcccgggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacatt

SEQ ID NO: 120510 - DNA, 1013 bp, Homo sapiens
  Payload ID: 3622
  Gene Symbol: COQ6
  Gene Name: coenzyme Q6 monooxygenase
  ENST ID: ENST00000557584
  CDS Start-End: 33-368
gagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccggtaagaggtccttctgaccagtccgcccacatgcatgcaagcctttcctcttcactttctctcagcctttttctggtttcaagggaatctgcccaggctgtttgtaagttccctttttgtctttttatgcttgagagtttccaagtgcagcagagtcttagccgttggtattggtgttcttttgacacagctctcagacaccttgagttccttggtttggtccacgtcccatgaacatgcagcagagctagttagca

SEQ ID NO: 120511 - DNA, 1486 bp, Homo sapiens
  Payload ID: 3622
  Gene Symbol: COQ6
  Gene Name: coenzyme Q6 monooxygenase
  ENST ID: ENST00000554341
  CDS Start-End: 154-414
ctttcccgggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaaattatggcctttgcaagcaaatgagtactcctctcctaaagaaagattacgttgatgaaaaagaacatcctgcccaggacccatcataca

SEQ ID NO: 120512 - DNA, 864 bp, Homo sapiens
  Payload ID: 3622
  Gene Symbol: COQ6
  Gene Name: coenzyme Q6 monooxygenase
  ENST ID: ENST00000554320
  CDS Start-End: 78-864
cggaaaccgggccgcggaggcacgatgagagccgtgagagccctagcacgacttgcccaaagacaatttctcaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccaggg

SEQ ID NO: 120513 - DNA, 737 bp, Homo sapiens
  Payload ID: 3622
  Gene Symbol: COQ6
  Gene Name: coenzyme Q6 monooxygenase
  ENST ID: ENST00000555196
  CDS Start-End: 99-263
cttctccaggctactagtggccggaaaccgggccgcggaggcacgatgagagccgtgagagccctagcacgacttgcccaaagacaatttctcaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaagctgccaaacttttctgaagaggctatacaatttcactttcccaccagtctataagggttccagtttctccacatcctcaccaacgcttattttccttctgtaaaaaaaaactgtagccatcctgttgagagtgaagttgtatctcattgtagtagtggttgcatttccttaataactaatgatgctgagtatcttttcatgtccttactggccatttgtgtatccactttggagaaatgtctgttcaaaatattttgcctgtttttaaattggattatttgtttttgagttataggagttctttatatattttaaatataa

SEQ ID NO: 120514 - DNA, 649 bp, Homo sapiens
  Payload ID: 3622
  Gene Symbol: COQ6
  Gene Name: coenzyme Q6 monooxygenase
  ENST ID: ENST00000554920
  CDS Start-End: 26-628
gagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctggaacagattatggcctttgcaagcaaatgagtactcctctcctaaagaaagattacgttgatgaaaaagaacatcctgcccaggacccatcatacatattttcaagatcttatttaatttaataaacttactttacattaaaa

SEQ ID NO: 120515 - DNA, 552 bp, Homo sapiens
  Payload ID: 3622
  Gene Symbol: COQ6
  Gene Name: coenzyme Q6 monooxygenase
  ENST ID: ENST00000554153
  CDS Start-End: 33-368
gagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattacccta

SEQ ID NO: 120516 - DNA, 1538 bp, Homo sapiens
  Payload ID: 3622
  Gene Symbol: COQ6
  Gene Name: coenzyme Q6 monooxygenase
  ENST ID: ENST00000629426
  CDS Start-End: 248-1429
cgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacatt

SEQ ID NO: 120517 - DNA, 2657 bp, Homo sapiens
  Payload ID: 3623
  Gene Symbol: COQ7
  Gene Name: coenzyme Q7 homolog, ubiquinone (yeast)
  Uniprot ID: Q99807
  ENST ID: ENST00000321998
  CDS Start-End: 67-720
gtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaa

SEQ ID NO: 120518 - DNA, 819 bp, Homo sapiens
  Payload ID: 3623
  Gene Symbol: COQ7
  Gene Name: coenzyme Q7 homolog, ubiquinone (yeast)
  Uniprot ID: Q99807
  ENST ID: ENST00000544894
  CDS Start-End: 134-673
agcggcgagagtgacaggaggacaggggttgtttcggcagtgacgcctggggagtgacgcaattgcacccctgtgcagtgatgtcacggcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaa

SEQ ID NO: 120519 - DNA, 2575 bp, Homo sapiens
  Payload ID: 3623
  Gene Symbol: COQ7
  Gene Name: coenzyme Q7 homolog, ubiquinone (yeast)
  ENST ID: ENST00000569127
  CDS Start-End: 887-1471
gtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatgcactgtaaactgtgaaagccatcagtgtagtggaaggagcatcgaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaaccccgcctctactaaaaatacaaaaatttgccaggcgtgatggcaggtgcctgtaatcccagctactcaggaggctgagacaggagaatcgcttgaacccgggaggcagagattgctttgaggcgagattgcaccactgcactgcaacctgggcgtcagagcgagactttgtctcccccgcgcaaaaaaaaaaaaaaaaaagaaatttcatgaagtcgttttctcaacgttaaattaccgtgtaccactttcgggatttttgcctaatggcagtactgcttgaacttttgattactagatgtgtttttttgtatagctatgtcccatttaaaaattaaattaatttccttgaaacaaaatccttatggtgaatgggaagccagtgccacttgccacaaatggcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagcca

SEQ ID NO: 120520 - DNA, 703 bp, Homo sapiens
  Payload ID: 3623
  Gene Symbol: COQ7
  Gene Name: coenzyme Q7 homolog, ubiquinone (yeast)
  ENST ID: ENST00000566049
  CDS Start-End: 40-360
ttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcaggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataag

SEQ ID NO: 120521 - DNA, 714 bp, Homo sapiens
  Payload ID: 3623
  Gene Symbol: COQ7
  Gene Name: coenzyme Q7 homolog, ubiquinone (yeast)
  Uniprot ID: Q99807
  ENST ID: ENST00000568985
  CDS Start-End: 25-678
tggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaatgtgagacttcaaggggaagtatgagacttctctg

SEQ ID NO: 120522 - DNA, 590 bp, Homo sapiens
  Payload ID: 3623
  Gene Symbol: COQ7
  Gene Name: coenzyme Q7 homolog, ubiquinone (yeast)
  ENST ID: ENST00000566110
  CDS Start-End: 281-590
gttgctttttttagttccggcaatgagttgcgccggggcggcggcggctccccgcctttggcggctgcgcccgggggcccggcggtccctctcaggttaaacagagtccgtttatgggcacgcctggcccatggggaactgatttgtgacctccatcccaaagtgccctttctgctgtctgtaaaaggaacatctggattttacctgatcataacgaagaataaacacttgcatttcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtgg

SEQ ID NO: 120523 - DNA, 739 bp, Homo sapiens
  Payload ID: 3623
  Gene Symbol: COQ7
  Gene Name: coenzyme Q7 homolog, ubiquinone (yeast)
  ENST ID: ENST00000561858
  CDS Start-End: 349-739
agagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttc

SEQ ID NO: 120524 - DNA, 840 bp, Homo sapiens
  Payload ID: 3623
  Gene Symbol: COQ7
  Gene Name: coenzyme Q7 homolog, ubiquinone (yeast)
  ENST ID: ENST00000569312
  CDS Start-End: 5-415
ggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggtacgtgtctctctagaagagcttatgcaagcttggggatctaggatgattaaatccttcaggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaatt

SEQ ID NO: 120525 - DNA, 1677 bp, Homo sapiens
  Payload ID: 3624
  Gene Symbol: COQ9
  Gene Name: coenzyme Q9
  Uniprot ID: O75208
  ENST ID: ENST00000262507
  CDS Start-End: 70-1026
cgccctccttagggccgtggtcccgtagctaccggtcgcgtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtttccca

SEQ ID NO: 120526 - DNA, 935 bp, Homo sapiens
  Payload ID: 3624
  Gene Symbol: COQ9
  Gene Name: coenzyme Q9
  ENST ID: ENST00000564655
  CDS Start-End: 25-935
gtgggcgacgtgcccgcttccaaaatggcggcggcggcggtatctggtgcgcttggccgggcgggctggaggctcctgcagctgcgatgcctgcccgtttctgtttcagtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaagg

SEQ ID NO: 120527 - DNA, 845 bp, Homo sapiens
  Payload ID: 3624
  Gene Symbol: COQ9
  Gene Name: coenzyme Q9
  ENST ID: ENST00000564115
  CDS Start-End: 20-586
cgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgc

SEQ ID NO: 120528 - DNA, 399 bp, Homo sapiens
  Payload ID: 3624
  Gene Symbol: COQ9
  Gene Name: coenzyme Q9
  ENST ID: ENST00000563166
  CDS Start-End: 1-309
cagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggtgtgattccaggcctggtgtcacatgacaccagcatgcattgcaggattattagtgtattttgagtctgtaaaaataataaatatgtttgaagta

SEQ ID NO: 120529 - DNA, 713 bp, Homo sapiens
  Payload ID: 3624
  Gene Symbol: COQ9
  Gene Name: coenzyme Q9
  ENST ID: ENST00000563391
  CDS Start-End: 445-713
gcctggctagcttcggccctgctccgctgtctgtgaggggcagatgcagcggggcagggcctgtcacccccatttcatggagttggcagagcctcagagagggctcgggtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatga

SEQ ID NO: 120530 - DNA, 882 bp, Homo sapiens
  Payload ID: 3624
  Gene Symbol: COQ9
  Gene Name: coenzyme Q9
  ENST ID: ENST00000567933
  CDS Start-End: 10-633
gcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactg

SEQ ID NO: 120531 - DNA, 1482 bp, Homo sapiens
  Payload ID: 3624
  Gene Symbol: COQ9
  Gene Name: coenzyme Q9
  ENST ID: ENST00000567072
  CDS Start-End: 13-864
cccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgt

SEQ ID NO: 120532 - DNA, 581 bp, Homo sapiens
  Payload ID: 3624
  Gene Symbol: COQ9
  Gene Name: coenzyme Q9
  ENST ID: ENST00000565964
  CDS Start-End: 66-581
ctccttagggccgtggtcccgtagctaccggtcgcgtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccaggccctcagcatcctcatgctccctcacaacatcccgtccagcctgagcctgctcaccagcatggtggatgacatgtggcattacgctggggaccagtccactgattttaactggtacacccgccgagccatgctggct

SEQ ID NO: 120533 - DNA, 1234 bp, Homo sapiens
  Payload ID: 3625
  Gene Symbol: CFL1
  Gene Name: cofilin 1 (non-muscle)
  Uniprot ID: P23528
  ENST ID: ENST00000308162
  CDS Start-End: 235-735
ggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgatt

SEQ ID NO: 120534 - DNA, 758 bp, Homo sapiens
  Payload ID: 3625
  Gene Symbol: CFL1
  Gene Name: cofilin 1 (non-muscle)
  ENST ID: ENST00000534769
  CDS Start-End: 49-663
cctggacttccgcaagtcgcccctgcggggctggactgttctctccagatggtgagtccggggcatggtcacctgcgggagagaaaagagttaactccacactccacgaatccggcagctgcgaggatctgggatgcaacctactcagatggttacgtgagaccggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctgg

SEQ ID NO: 120535 - DNA, 567 bp, Homo sapiens
  Payload ID: 3625
  Gene Symbol: CFL1
  Gene Name: cofilin 1 (non-muscle)
  ENST ID: ENST00000526975
  CDS Start-End: 296-567
cgggagtccgggcgggggcggtgctgtggaatgtccccgactacaacccccgctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagac

SEQ ID NO: 120536 - DNA, 962 bp, Homo sapiens
  Payload ID: 3625
  Gene Symbol: CFL1
  Gene Name: cofilin 1 (non-muscle)
  ENST ID: ENST00000527344
  CDS Start-End: 152-601
acgtggccggcttcttctgcagttccggggagtttgggggaccagatttaccttggattgcccctccctctcctggctcgggcaccccgaagcacgacgcagagcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtg

SEQ ID NO: 120537 - DNA, 860 bp, Homo sapiens
  Payload ID: 3625
  Gene Symbol: CFL1
  Gene Name: cofilin 1 (non-muscle)
  ENST ID: ENST00000524553
  CDS Start-End: 129-578
ctcctggctcgggcaccccgaagcacgacgcagagtaggaagagtttaaagacctcgaggcctctgggcacttgagtttggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcc

SEQ ID NO: 120538 - DNA, 1878 bp, Homo sapiens
  Payload ID: 3625
  Gene Symbol: CFL1
  Gene Name: cofilin 1 (non-muscle)
  Uniprot ID: P23528
  ENST ID: ENST00000525451
  CDS Start-End: 717-1217
aactgcgaagcccccctctctctccccgttgctcttggaaactctaaggctcagaaaagggggcgctagcctcatattcatgtagggtcgctcgcgggaggcggggtcaagctgctgtctccacctggagcgccgggagtccgggcgggggcggtgctgtggaatgtccccgactacaacccccggtcgggattccaggctaatcaatagttgcttcgattcagaaatgcaaaaccctaacctcactcaaaaatttcaggccaagggatccagataataccagatgggtcttaagaaagccgttttgctgtgggataaagagccgcttagtcggggatcgttttcgggtcattttactgagcgccgcctcgccgggctcagagcggttcctgggaaattggaccaatgggctcgcgctgcgcgctgcggtgccgcccaggacctgggcctacatttccctacatgcactgcagctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatgggatgtgtttttcaaggttgggacacaggagacttcaggattgggggtgcactgggataatggtgctatctctctcctctgtactccacacccaaccagcccctgcacacccttatctggctcc

SEQ ID NO: 120539 - DNA, 636 bp, Homo sapiens
  Payload ID: 3625
  Gene Symbol: CFL1
  Gene Name: cofilin 1 (non-muscle)
  ENST ID: ENST00000531413
  CDS Start-End: 108-557
ggagcgccgggagtccgggcgggggcggtgctgtggaatgtccccgactacaacccccggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgcc

SEQ ID NO: 120540 - DNA, 737 bp, Homo sapiens
  Payload ID: 3625
  Gene Symbol: CFL1
  Gene Name: cofilin 1 (non-muscle)
  ENST ID: ENST00000534784
  CDS Start-End: 500-737
cccggttggggcgtgggtgcctgcgattaaggccttgcaccgcaaggcttggagggggcatcgcagagaccgcggcccgttcgggagcgcatctaacgagctgcgttctcacccgtgcatcgggcgagggctggaacggcgctgtctgtcggcgcgtgcgcgcacgctcaggcccggccgccggtgccgaagccctgggccagcgaggccttcccggatgggcctgagtgagggtggagccgagtttagggaagtgacccaggcgggcaccgcccggaaaccaccccgccccctgtatacggcccgagggctgagaaaaccgaaggttatgtagcttgcccaggctcctgcctgcaggagatgggtctgatacacccgttgttttagggcgattccacagggttagggacctggagatgctgctgcctctcggatacgcgtttctgcattggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaagg

SEQ ID NO: 120541 - DNA, 1062 bp, Homo sapiens
  Payload ID: 3625
  Gene Symbol: CFL1
  Gene Name: cofilin 1 (non-muscle)
  ENST ID: ENST00000531407
  CDS Start-End: 286-735
gctggtgcgcccgcgcggacaccggccgcggggggaggggttcggggcgcgcgctggggcgcccctcgcggaacggccggcgtcgcgcctttcttcttaggggcgcgctctcgactggagcatgcggcgtccaaacccggcccgggggcggcgaggaaaaagcgcgcgagaggtctcggcgcgcgcgccccacccaaggctgttcctgtctgcgcgtcaccctccctcggcagccgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccc

SEQ ID NO: 120542 - DNA, 855 bp, Homo sapiens
  Payload ID: 3625
  Gene Symbol: CFL1
  Gene Name: cofilin 1 (non-muscle)
  ENST ID: ENST00000532134
  CDS Start-End: 377-855
accagcagtatcactcgggctcctgagtgccgagctggccagtagctgccagagcctcccgctttgggctgggcaggaacctgaaaggtacagaggagttctgaacatgaaagccagccagtcatctttgaataagtccccagcaggctttgtggccctgggttaaaatactaagtcgaaaagaggataagtcatttgctcaaggccaggcatcactggtgagatttggactcaggcttgccaaatcccccaagccagaaaatcatactcccgcactcccactttgccttccactccccttgccccttcctcactggcatggaagagtcctggacttccgcaagtcgcccctgcggggctggactgttctctccagatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctc

SEQ ID NO: 120543 - DNA, 647 bp, Homo sapiens
  Payload ID: 3625
  Gene Symbol: CFL1
  Gene Name: cofilin 1 (non-muscle)
  ENST ID: ENST00000530413
  CDS Start-End: 280-647
atcctgtaaaatgagggaaggggttgttgaactaggtgatcagaggccatggctgccattctgaggttgtgtcccatctggttctttgacagtgacttgggtgggaaaactagtgacttgccttgggaagggcactagtgaccactcgggacgtggactgagatcttctgaaaaaacaaggggcagttccctagaatccttttcttgacgtatacgtggcatgtctcctaggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgcta

SEQ ID NO: 120544 - DNA, 6747 bp, Homo sapiens
  Payload ID: 3626
  Gene Symbol: CFL2
  Gene Name: cofilin 2 (muscle)
  Uniprot ID: Q9Y281
  ENST ID: ENST00000298159
  CDS Start-End: 151-651
ggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggtatttcagatcaaagaggcatcattatctttattctgtttttcaggattttagttggtaatactttctcatttatcaataacaattttctttaaaaactgagtgttacagcaattaattttagcattttcagacaaatgggaacagttggcatgtgtcccaaactggctatcagctgttgttttccatcattatctaaaatagtgtggccagcattgtgtattgaaatgtgcctttttcgtacattggaagagaagcctcttactgggtttgagtttctctgatacagaacatttgtagcagctaatttatggaatctggcaaataagctttgggaggaaattcttttaaaagtgttttcttgttaaggaataatctcaacaatggtaaatcatcaagaggttgagaagactcttaggtttgccactcagaaaaaacagtctcattttgctcttcataggtcctgtttttgcttgcacatttaatagtaggtggagatgcaaaacaacgtgaatgttcatttttttatgaatagtattaaagctactagaggtgggcaggcaggtcccagtaaatgttgcctttttttttttttttttttgagacagggtctcactctgttgcccaggctggagtgcagtgtcaaaatttcagctcacttcaaactcaaccttcccagctcagatgatcctcccacctcagcctcccaagtagctgggactacaggcatgcaccaccatgcctaattttttttttttttttttttgtatctcttttgtagagactgagtttggccatgttgcctaggctgatctccaactcctgggctcaagctgtcctctgacctccgcctcccaaaagtgctaggattgcatgcatgagccaccacttcaaaagctcaaatactgcttttgaagacagcatgagtttatggatgttctgtctcctttcagcccataaagaagtctgaggcttttcttttgctctggaacatccaactaattgctttatttccatgtagaagtagaggaatcatccctccacttaaatttcctctcataatgcaatttggcaaattaaatctctaaatctcagttttttaacccatagtatgggaacggtaatatctgtttaccatgtttcctgagtactaaatatggaaatggtttttgaaaacaggaaaatgctatgtaaatgcaataatctgtttaaactattcattcttaattactgtatgtaagtagataaatattaaatgtttttgttaaaagatgtattacagatcattgaacctctatttttgtaacttccgtgtgtgtacatatatatatgtatatatatatgtatatatacacacatacacacacatttttttcttcttttttggacagggtttcactctattgcccaggctgctgtgcagtggcacaatcatagctcaatataaccttgaactcctgggctcaagtgatcctcccacctcaagctcctgagcagctgggattatagacatacaccaccatgcccagctaattttttttttttttttttttttgagacaaagtctcactgtatcacccacgctggagggcggtggtgtgatctcggctcactgcaacctctgcctcctgggttcaagcaattctcctgcctcagcctcccgaatagctgggactacaggcatatgccaccacacctggctaatttttgtatttttaatacagatgggatttcaccatgttggccaggctggtctcaaactcctgacctcaggtgatctgcctgcctcagcctcccaaagtgctgggattacaggcatgagccaccatgcccggcctgcccagctaatttaaaaaaaaaaaaattgttgagacggggtctcactgtgttgtctaggctagtcttgaattcctggccttaagcaatccacccatctcaacttcccaaagcactgggattataggtgtgaaccactgggctgagcctatttagtgtgtatatagagatggggtttcaacatgttggctaggctggtcttgaactcctgaccttaggagatccgcccaccttggcttcccaaactgctgggattatgggcttgagccactgcactggccctatttagtatatttttaaagtagcatctttcaagaatatttgaaaaacaatcctaagattgttttctaaaaaagctcatgctcataaaaatctaaaaagttgtatatttcaaagatgttctgaaatatttcagtattgtaaacttatggaatctgtgccaaacgaggattgtatagacacagaaagctggtgtctcttaatccttttccagaaacttggatatatccctcccctacccatctttctaagaagagatagtactttatgttatagtgggtaagtcctaggactttggcattagattgcttggttgtttacatagagccctttaacacttagtaactggatagtcttagacaaatcgtataacctcttggaagcttagttactacatctataaaatggggatgattgtactccgtctcataggattgtgagcataactgaaagcacttggaatagttcctagcacataataagggctcagtaggatgatcctataagatttacaggccaaaccagaacactttttgaaaatgaaagggagagctattaattatgccaagacaacaggcttgagataggccaatcccaagcaaaccaggaggtgttgtccagaagtataggctaatattaaaatgtaatacttaaacaatgaactgtatgaaagactcaagatcatcatttattaattttaattatataatgtattagcatactgacttgaggatctcacgaagtatatgagtggtcttaagtaaacctcagagagatcgaatttggctttttaagcctttttaatagcgttccttctgacttttttttttttttggagatggagtcttcctctgtcacccaggctggagtgcagtgacgcgatattggctcgctgcaagctccaccttctgggttcacgccattctcctgcctcagtctcccgagtagctgggactacaggtgtccgccaccacgcccggctaactttttgtatttttagtagaggtggggtttcaccgtgttagccaggatggtctccatctcctgacctcatgatccgcccaccttggcctcccaaagtgctgggattacaagcatgagcctccttttgactttcatacttgtaaactgtcagatattatgttttgctactatcagtatgctttgtctatagcagcttctgctaatagttgcttttcatctcgtggatttggaaaaccaggtttgttataattatgtataagcaaataaataggcccagagtgaagacttgagagcaaaatgcctgaacacatgcaccttatttttgggggctgtttaaataactttgtgatgtactttcagggtttgggttgttttttgtttgttttaataaaaggtatgtaaaagagctgaactgtaaataggtattactgtatctcagggaggtgtctgcagtattattagtatttaaggaaatcatacttgctgttgacagtacctgtatcattaaaggctcacaaaga

SEQ ID NO: 120545 - DNA, 3131 bp, Homo sapiens
  Payload ID: 3626
  Gene Symbol: CFL2
  Gene Name: cofilin 2 (muscle)
  Uniprot ID: Q9Y281
  ENST ID: ENST00000341223
  CDS Start-End: 153-653
aaacatttcagggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggt

SEQ ID NO: 120546 - DNA, 1223 bp, Homo sapiens
  Payload ID: 3626
  Gene Symbol: CFL2
  Gene Name: cofilin 2 (muscle)
  ENST ID: ENST00000422678
  CDS Start-End: 38-214
agcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgt

SEQ ID NO: 120547 - DNA, 1387 bp, Homo sapiens
  Payload ID: 3626
  Gene Symbol: CFL2
  Gene Name: cofilin 2 (muscle)
  ENST ID: ENST00000554470
  CDS Start-End: 284-349
cgcgctctgaggtcaggccgaggacgcggacagccggggagccggggccgcgagacagaagggccggcctgggagcgggtggcgccggctggggaccaggcgtgcccacgtgaccgccccgcccgctgcctgcggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaaggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaa

SEQ ID NO: 120548 - DNA, 546 bp, Homo sapiens
  Payload ID: 3626
  Gene Symbol: CFL2
  Gene Name: cofilin 2 (muscle)
  Uniprot ID: Q9Y281
  ENST ID: ENST00000556161
  CDS Start-End: 90-539
tcgcttcctaattttacttaacacgcgaggctttaaaattggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgaca

SEQ ID NO: 120549 - DNA, 632 bp, Homo sapiens
  Payload ID: 3626
  Gene Symbol: CFL2
  Gene Name: cofilin 2 (muscle)
  Uniprot ID: Q9Y281
  ENST ID: ENST00000555765
  CDS Start-End: 170-619
acagccgagggcactatggtaagacgagcgcgctggccgggaggccgcggcgaggcgagaaaagccccccgcacggccccgggagtgaggccgccattttaacctgattttggcctccaaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaag

SEQ ID NO: 120550 - DNA, 2625 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000376266
  CDS Start-End: 124-2472
aggggcagaggcggggccgggagcgaggcgtagggggtgtggccaaagcgcagtagggggctctcgcggttggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120551 - DNA, 2600 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000383341
  CDS Start-End: 99-2447
aggcgtagggggagtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgttggtggcagcagcagacagcctcagccgaggagcagttgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120552 - DNA, 2600 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000383527
  CDS Start-End: 99-2447
aggcgtagggggtgtggccaaagcgcagtagggggctctcgcggttggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaatttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagctgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcttctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120553 - DNA, 2490 bp, Homo sapiens
  Payload ID: 3627
  Gene Symbol: CCHCR1
  Gene Name: coiled-coil alpha-helical rod protein 1
  ENST ID: ENST00000396263
  CDS Start-End: 153-2342
tgtggccaaagcgcagtagggggctctcgcggttggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacag

SEQ ID NO: 120554 - DNA, 2958 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000396268
  CDS Start-End: 190-2805
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120555 - DNA, 2494 bp, Homo sapiens
  Payload ID: 3627
  Gene Symbol: CCHCR1
  Gene Name: coiled-coil alpha-helical rod protein 1
  ENST ID: ENST00000400351
  CDS Start-End: 152-2341
gtggccaaagcgcagtagggggctctcgcggttggggctttctctttggaaggtggcctgaaaattgaattggagtgtctttgtttctcctcttgtccaggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgttggtggcagcagcagacagcctcagccgaggagcagttgaggcttgtggtcaatgctgtcagcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120556 - DNA, 2958 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000400352
  CDS Start-End: 457-2805
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgttggtggcagcagcagacagcctcagccgaggagcagttgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120557 - DNA, 2495 bp, Homo sapiens
  Payload ID: 3627
  Gene Symbol: CCHCR1
  Gene Name: coiled-coil alpha-helical rod protein 1
  ENST ID: ENST00000400406
  CDS Start-End: 153-2342
tgtggccaaagcgcagtagggggctctcgcggttggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaatttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagctgaggagcagctgaggcttgtggtcaatgctgtcagcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcttctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120558 - DNA, 2958 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000400412
  CDS Start-End: 190-2805
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaatttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagctgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcttctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120559 - DNA, 838 bp, Homo sapiens
  Payload ID: 3627
  Gene Symbol: CCHCR1
  Gene Name: coiled-coil alpha-helical rod protein 1
  ENST ID: ENST00000432736
  CDS Start-End: 483-838
tgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtaaaggcactgcccagaatcctgaaagggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaa

SEQ ID NO: 120560 - DNA, 700 bp, Homo sapiens
  Payload ID: 3627
  Gene Symbol: CCHCR1
  Gene Name: coiled-coil alpha-helical rod protein 1
  ENST ID: ENST00000439820
  CDS Start-End: 136-700
agggggtacaggggccaggtgaagggacagatgaagcgatcagaacagccttagagctcacgggctaactgggtgaagcctcgggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaatttggaagaggggagccagcgggagctggaagaggttcagaggctgcaccaagagcagctgtcctctttgacacaggctcacgaggagg

SEQ ID NO: 120561 - DNA, 740 bp, Homo sapiens
  Payload ID: 3627
  Gene Symbol: CCHCR1
  Gene Name: coiled-coil alpha-helical rod protein 1
  ENST ID: ENST00000457929
  CDS Start-End: 227-740
gccaggtgaagggacagatgaagagatcagaacagccttagagctcacgggctaactgggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcc

SEQ ID NO: 120562 - DNA, 470 bp, Homo sapiens
  Payload ID: 3627
  Gene Symbol: CCHCR1
  Gene Name: coiled-coil alpha-helical rod protein 1
  ENST ID: ENST00000428174
  CDS Start-End: 91-470
ggggtgtggccaaagcgcagtagggggctctcgcggttggggaacatagatggctggagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagct

SEQ ID NO: 120563 - DNA, 470 bp, Homo sapiens
  Payload ID: 3627
  Gene Symbol: CCHCR1
  Gene Name: coiled-coil alpha-helical rod protein 1
  ENST ID: ENST00000452419
  CDS Start-End: 91-470
ggggagtggccaaagcgcagtagggggctctcgcggttggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagct

SEQ ID NO: 120564 - DNA, 699 bp, Homo sapiens
  Payload ID: 3627
  Gene Symbol: CCHCR1
  Gene Name: coiled-coil alpha-helical rod protein 1
  ENST ID: ENST00000448162
  CDS Start-End: 135-699
gggggtacaggggccaggtgaagggacagatgaagagatcagaacagccttagagctcacgggctaactgggtgaagcctcgggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggagg

SEQ ID NO: 120565 - DNA, 922 bp, Homo sapiens
  Payload ID: 3627
  Gene Symbol: CCHCR1
  Gene Name: coiled-coil alpha-helical rod protein 1
  ENST ID: ENST00000451470
  CDS Start-End: 1-769
ccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctgcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120566 - DNA, 922 bp, Homo sapiens
  Payload ID: 3627
  Gene Symbol: CCHCR1
  Gene Name: coiled-coil alpha-helical rod protein 1
  ENST ID: ENST00000431539
  CDS Start-End: 1-769
ccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctgcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120567 - DNA, 922 bp, Homo sapiens; identical to SEQ ID NO: 120565
  Payload ID: 3627
  Gene Symbol: CCHCR1
  Gene Name: coiled-coil alpha-helical rod protein 1
  ENST ID: ENST00000420262
  CDS Start-End: 1-769

SEQ ID NO: 120568 - DNA, 1000 bp, Homo sapiens
  Payload ID: 3627
  Gene Symbol: CCHCR1
  Gene Name: coiled-coil alpha-helical rod protein 1
  ENST ID: ENST00000439536
  CDS Start-End: 53-1000
ggggaacatagatggctgaagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggacaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggag

SEQ ID NO: 120569 - DNA, 2958 bp, Homo sapiens
  Payload ID: 3627
  Gene Symbol: CCHCR1
  Gene Name: coiled-coil alpha-helical rod protein 1
  ENST ID: ENST00000419528
  CDS Start-End: 457-2805
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggacaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120570 - DNA, 838 bp, Homo sapiens
  Payload ID: 3627
  Gene Symbol: CCHCR1
  Gene Name: coiled-coil alpha-helical rod protein 1
  ENST ID: ENST00000456712
  CDS Start-End: 189-838
tgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtagaggcactgcccagaatcctgaaagggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaa

SEQ ID NO: 120571 - DNA, 2600 bp, Homo sapiens; identical to SEQ ID NO: 120551
  Payload ID: 3627
  Gene Symbol: CCHCR1
  Gene Name: coiled-coil alpha-helical rod protein 1
  Uniprot ID: Q8TD31
  ENST ID: ENST00000425620
  CDS Start-End: 99-2447

SEQ ID NO: 120572 - DNA, 470 bp, Homo sapiens
  Payload ID: 3627
  Gene Symbol: CCHCR1
  Gene Name: coiled-coil alpha-helical rod protein 1
  ENST ID: ENST00000438424
  CDS Start-End: 91-470
ggggtgtggccaaagcgcagtagggggctctcgcggttggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagct

SEQ ID NO: 120573 - DNA, 740 bp, Homo sapiens
  Payload ID: 3627
  Gene Symbol: CCHCR1
  Gene Name: coiled-coil alpha-helical rod protein 1
  ENST ID: ENST00000417501
  CDS Start-End: 227-740
gccaggtgaagggacagatgaagagatcagaacagccttagagctcacgggctaactgggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcc

SEQ ID NO: 120574 - DNA, 1000 bp, Homo sapiens; identical to SEQ ID NO: 120568
  Payload ID: 3627
  Gene Symbol: CCHCR1
  Gene Name: coiled-coil alpha-helical rod protein 1
  ENST ID: ENST00000456365
  CDS Start-End: 53-1000

SEQ ID NO: 120575 - DNA, 838 bp, Homo sapiens
  Payload ID: 3627
  Gene Symbol: CCHCR1
  Gene Name: coiled-coil alpha-helical rod protein 1
  ENST ID: ENST00000451337
  CDS Start-End: 483-838
tgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtaaaggcactgcccagaatcctgaaagggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaa

SEQ ID NO: 120576 - DNA, 700 bp, Homo sapiens
  Payload ID: 3627
  Gene Symbol: CCHCR1
  Gene Name: coiled-coil alpha-helical rod protein 1
  ENST ID: ENST00000438812
  CDS Start-End: 136-700
agggggtacaggggccaggtgaagggacagatgaagagatcagaacagccttagagctcacgggctaactgggtgaagcctctggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggagg

SEQ ID NO: 120577 - DNA, 470 bp, Homo sapiens; identical to SEQ ID NO: 120563
  Payload ID: 3627
  Gene Symbol: CCHCR1
  Gene Name: coiled-coil alpha-helical rod protein 1
  ENST ID: ENST00000416552
  CDS Start-End: 91-470

SEQ ID NO: 120578 - DNA, 646 bp, Homo sapiens
  Payload ID: 3627
  Gene Symbol: CCHCR1
  Gene Name: coiled-coil alpha-helical rod protein 1
  ENST ID: ENST00000453360
  CDS Start-End: 189-646
agtagggggctctcgcggttggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggc

SEQ ID NO: 120579 - DNA, 838 bp, Homo sapiens; identical to SEQ ID NO: 120575
  Payload ID: 3627
  Gene Symbol: CCHCR1
  Gene Name: coiled-coil alpha-helical rod protein 1
  ENST ID: ENST00000444855
  CDS Start-End: 483-838

SEQ ID NO: 120580 - DNA, 676 bp, Homo sapiens
  Payload ID: 3627
  Gene Symbol: CCHCR1
  Gene Name: coiled-coil alpha-helical rod protein 1
  ENST ID: ENST00000455279
  CDS Start-End: 219-676
agcgaggcgtagggggtgtggccaaagcgcagtagggggctctcgcggttggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggc

SEQ ID NO: 120581 - DNA, 2495 bp, Homo sapiens
  Payload ID: 3627
  Gene Symbol: CCHCR1
  Gene Name: coiled-coil alpha-helical rod protein 1
  ENST ID: ENST00000414614
  CDS Start-End: 153-2342
agtggccaaagcgcagtagggggctctcgcggttggggctttctctttggaaggtggcctgaaaattgaattggagtgtctttgtttctcctcttgtccaggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgttggtggcagcagcagacagcctcagccgaggagcagttgaggcttgtggtcaatgctgtcagcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120582 - DNA, 740 bp, Homo sapiens; identical to SEQ ID NO: 120573
  Payload ID: 3627
  Gene Symbol: CCHCR1
  Gene Name: coiled-coil alpha-helical rod protein 1
  ENST ID: ENST00000450631
  CDS Start-End: 227-740

SEQ ID NO: 120583 - DNA, 740 bp, Homo sapiens
  Payload ID: 3627
  Gene Symbol: CCHCR1
  Gene Name: coiled-coil alpha-helical rod protein 1
  ENST ID: ENST00000412577
  CDS Start-End: 227-740
gccaggtgaagggacagatgaagcgatcagaacagccttagagctcacgggctaactgggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcc

SEQ ID NO: 120584 - DNA, 646 bp, Homo sapiens
  Payload ID: 3627
  Gene Symbol: CCHCR1
  Gene Name: coiled-coil alpha-helical rod protein 1
  ENST ID: ENST00000425500
  CDS Start-End: 189-646
agtagggggctctcgcggttggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggc

SEQ ID NO: 120585 - DNA, 2587 bp, Homo sapiens
  Payload ID: 3627
  Gene Symbol: CCHCR1
  Gene Name: coiled-coil alpha-helical rod protein 1
  Uniprot ID: Q8TD31
  ENST ID: ENST00000451521
  CDS Start-End: 8-2515
gccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagacca

SEQ ID NO: 120586 - DNA, 700 bp, Homo sapiens; identical to SEQ ID NO: 120576
  Payload ID: 3627
  Gene Symbol: CCHCR1
  Gene Name: coiled-coil alpha-helical rod protein 1
  ENST ID: ENST00000454570
  CDS Start-End: 136-700

SEQ ID NO: 120587 - DNA, 838 bp, Homo sapiens; identical to SEQ ID NO: 120570
  Payload ID: 3627
  Gene Symbol: CCHCR1
  Gene Name: coiled-coil alpha-helical rod protein 1
  ENST ID: ENST00000426967
  CDS Start-End: 189-838

SEQ ID NO: 120588 - DNA, 922 bp, Homo sapiens; identical to SEQ ID NO: 120566
  Payload ID: 3627
  Gene Symbol: CCHCR1
  Gene Name: coiled-coil alpha-helical rod protein 1
  ENST ID: ENST00000419592
  CDS Start-End: 1-769

SEQ ID NO: 120589 - DNA, 2600 bp, Homo sapiens
  Payload ID: 3627
  Gene Symbol: CCHCR1
  Gene Name: coiled-coil alpha-helical rod protein 1
  ENST ID: ENST00000416392
  CDS Start-End: 99-2447
aggcgtagggggtgtggccaaagcgcagtagggggctctcgcggttggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggacaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120590 - DNA, 700 bp, Homo sapiens
  Payload ID: 3627
  Gene Symbol: CCHCR1
  Gene Name: coiled-coil alpha-helical rod protein 1
  ENST ID: ENST00000438739
  CDS Start-End: 136-700
agggggtacaggggccaggtgaagggacagatgaagagatcagaacagccttagagctcacgggctaactgggtgaagcctcgggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggagg

SEQ ID NO: 120591 - DNA, 1000 bp, Homo sapiens
  Payload ID: 3627
  Gene Symbol: CCHCR1
  Gene Name: coiled-coil alpha-helical rod protein 1
  ENST ID: ENST00000429943
  CDS Start-End: 53-1000
ggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaatttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggag

SEQ ID NO: 120592 - DNA, 2495 bp, Homo sapiens
  Payload ID: 3627
  Gene Symbol: CCHCR1
  Gene Name: coiled-coil alpha-helical rod protein 1
  ENST ID: ENST00000452333
  CDS Start-End: 153-2342
tgtggccaaagcgcagtagggggctctcgcggttggggctttctctttggaaggtggcctgaaaattgaattggagtgtctttgtttctcctcttgtccaggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggacaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120593 - DNA, 838 bp, Homo sapiens; identical to SEQ ID NO: 120559
  Payload ID: 3627
  Gene Symbol: CCHCR1
  Gene Name: coiled-coil alpha-helical rod protein 1
  ENST ID: ENST00000427654
  CDS Start-End: 483-838

SEQ ID NO: 120594 - DNA, 2958 bp, Homo sapiens; identical to SEQ ID NO: 120569
  Payload ID: 3627
  Gene Symbol: CCHCR1
  Gene Name: coiled-coil alpha-helical rod protein 1
  ENST ID: ENST00000447252
  CDS Start-End: 457-2805

SEQ ID NO: 120595 - DNA, 2958 bp, Homo sapiens; identical to SEQ ID NO: 120556
  Payload ID: 3627
  Gene Symbol: CCHCR1
  Gene Name: coiled-coil alpha-helical rod protein 1
  Uniprot ID: Q8TD31
  ENST ID: ENST00000416163
  CDS Start-End: 457-2805

SEQ ID NO: 120596 - DNA, 740 bp, Homo sapiens; identical to SEQ ID NO: 120561
  Payload ID: 3627
  Gene Symbol: CCHCR1
  Gene Name: coiled-coil alpha-helical rod protein 1
  ENST ID: ENST00000423825
  CDS Start-End: 227-740

SEQ ID NO: 120597 - DNA, 1000 bp, Homo sapiens
  Payload ID: 3627
  Gene Symbol: CCHCR1
  Gene Name: coiled-coil alpha-helical rod protein 1
  ENST ID: ENST00000449364
  CDS Start-End: 53-1000
ggggaacatagatggctgaagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggag

SEQ ID NO: 120598 - DNA, 646 bp, Homo sapiens
  Payload ID: 3627
  Gene Symbol: CCHCR1
  Gene Name: coiled-coil alpha-helical rod protein 1
  ENST ID: ENST00000455669
  CDS Start-End: 189-646
agtagggggctctcgcggttggccttgctgagccatggagagaactctggagatggcgctcaagacccctgcactgtgtacctcctttctcacctctggccaggagcagcagggaccatagaaacttaaggaggagggggaacatagatggctgaagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggc

SEQ ID NO: 120599 - DNA, 1000 bp, Homo sapiens; identical to SEQ ID NO: 120597
  Payload ID: 3627
  Gene Symbol: CCHCR1
  Gene Name: coiled-coil alpha-helical rod protein 1
  ENST ID: ENST00000444737
  CDS Start-End: 53-1000

SEQ ID NO: 120600 - DNA, 470 bp, Homo sapiens; identical to SEQ ID NO: 120562
  Payload ID: 3627
  Gene Symbol: CCHCR1
  Gene Name: coiled-coil alpha-helical rod protein 1
  ENST ID: ENST00000437027
  CDS Start-End: 91-470

SEQ ID NO: 120601 - DNA, 646 bp, Homo sapiens; identical to SEQ ID NO: 120578
  Payload ID: 3627
  Gene Symbol: CCHCR1
  Gene Name: coiled-coil alpha-helical rod protein 1
  ENST ID: ENST00000425351
  CDS Start-End: 189-646

SEQ ID NO: 120602 - DNA, 470 bp, Homo sapiens; identical to SEQ ID NO: 120572
  Payload ID: 3627
  Gene Symbol: CCHCR1
  Gene Name: coiled-coil alpha-helical rod protein 1
  ENST ID: ENST00000416850
  CDS Start-End: 91-470

SEQ ID NO: 120603 - DNA, 646 bp, Homo sapiens; identical to SEQ ID NO: 120598
  Payload ID: 3627
  Gene Symbol: CCHCR1
  Gene Name: coiled-coil alpha-helical rod protein 1
  ENST ID: ENST00000437918
  CDS Start-End: 189-646

SEQ ID NO: 120604 - DNA, 700 bp, Homo sapiens; identical to SEQ ID NO: 120590
  Payload ID: 3627
  Gene Symbol: CCHCR1
  Gene Name: coiled-coil alpha-helical rod protein 1
  ENST ID: ENST00000447874
  CDS Start-End: 136-700

SEQ ID NO: 120605 - DNA, 664 bp, Homo sapiens
  Payload ID: 3627
  Gene Symbol: CCHCR1
  Gene Name: coiled-coil alpha-helical rod protein 1
  ENST ID: ENST00000448141
  CDS Start-End: 91-664
gtagggggtgtggccaaagcgcagtagggggctctcgcggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgc

SEQ ID NO: 120606 - DNA, 2600 bp, Homo sapiens; identical to SEQ ID NO: 120589
  Payload ID: 3627
  Gene Symbol: CCHCR1
  Gene Name: coiled-coil alpha-helical rod protein 1
  ENST ID: ENST00000433804
  CDS Start-End: 99-2447

SEQ ID NO: 120607 - DNA, 922 bp, Homo sapiens
  Payload ID: 3627
  Gene Symbol: CCHCR1
  Gene Name: coiled-coil alpha-helical rod protein 1
  ENST ID: ENST00000417776
  CDS Start-End: 1-769
ccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctgcagcgactgttgacagttcttccttccctactggataagaagaaatctgtggtgtccagccccaggcctccagagtgttcagcttctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagga

SEQ ID NO: 120608 - DNA, 2495 bp, Homo sapiens; identical to SEQ ID NO: 120592
  Payload ID: 3627
  Gene Symbol: CCHCR1
  Gene Name: coiled-coil alpha-helical rod protein 1
  ENST ID: ENST00000428677
  CDS Start-End: 153-2342

SEQ ID NO: 120609 - DNA, 589 bp, Homo sapiens
  Payload ID: 3627
  Gene Symbol: CCHCR1
  Gene Name: coiled-coil alpha-helical rod protein 1
  ENST ID: ENST00000507829
  CDS Start-End: 243-589
gaggcgtagggggtgtggccaaagcgcagtagggggctctcgcggttggccttgctgagccatggagagaactctggagatggcgctcaagacccctgcactgtgtacctcctttctcacctctggccaggagcagcagggaccatagaaacttaaggaggagggtagaggcactgcccagaatcctgaaagggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgct

SEQ ID NO: 120610 - DNA, 588 bp, Homo sapiens
  Payload ID: 3627
  Gene Symbol: CCHCR1
  Gene Name: coiled-coil alpha-helical rod protein 1
  ENST ID: ENST00000507751
  CDS Start-End: 115-588
aggggccaggtgaagggacagatgaagagatcagaacagccttagagctcacgggctaactgggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaag

SEQ ID NO: 120611 - DNA, 567 bp, Homo sapiens
  Payload ID: 3627
  Gene Symbol: CCHCR1
  Gene Name: coiled-coil alpha-helical rod protein 1
  ENST ID: ENST00000508683
  CDS Start-End: 89-567
ggtgtggccaaagcgcagtagggggctctcgcggttggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcgggagctggaagaggttcagaggctgcaccaagagcagctgtcctctttgacacaggctcacgaggaggctctttccagtttgaccagcaa

SEQ ID NO: 120612 - DNA, 582 bp, Homo sapiens
  Payload ID: 3627
  Gene Symbol: CCHCR1
  Gene Name: coiled-coil alpha-helical rod protein 1
  ENST ID: ENST00000507459
  CDS Start-End: 76-318
aaagcgcagtagggggctctcgcggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgac

SEQ ID NO: 120613 - DNA, 580 bp, Homo sapiens
  Payload ID: 3627
  Gene Symbol: CCHCR1
  Gene Name: coiled-coil alpha-helical rod protein 1
  ENST ID: ENST00000503420
  CDS Start-End: 202-580
gacgttcgggaagagtcggttgggggcgggaaggggctgagcgggggtcctgggagggttcaaggggtccaaaggggaagggggtacaggggccaggtgaagggacagatgaagagatcagaacagccttagagctcacgggctaactgggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagagg

SEQ ID NO: 120614 - DNA, 715 bp, Homo sapiens
  Payload ID: 3627
  Gene Symbol: CCHCR1
  Gene Name: coiled-coil alpha-helical rod protein 1
  ENST ID: ENST00000488920
  CDS Start-End: 173-415
ggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcag

SEQ ID NO: 120615 - DNA, 589 bp, Homo sapiens
  Payload ID: 3627
  Gene Symbol: CCHCR1
  Gene Name: coiled-coil alpha-helical rod protein 1
  ENST ID: ENST00000508852
  CDS Start-End: 80-322
aaagcgcagtagggggctctcgcggttggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacaga

SEQ ID NO: 120616 - DNA, 479 bp, Homo sapiens
  Payload ID: 3627
  Gene Symbol: CCHCR1
  Gene Name: coiled-coil alpha-helical rod protein 1
  ENST ID: ENST00000507892
  CDS Start-End: 357-479
gacgttcgggaagagtcggttgggggcgggaaggggctgagcgggggtcctgggagggttcaaggggtccaaaggggaagggggtacaggggccaggtgaagggacagatgaagagatcagaacagccttagagctcacgggctaactgggtgaagcctcgggccttgctgagccatggagagaactctggagatggcgctcaagacccctgcactgtgtacctcctttctcacctctggccaggagcagcagggaccatagaaacttaaggaggagggtagaggcactgcccagaatcctgaaagggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaaccccca

SEQ ID NO: 120617 - DNA, 544 bp, Homo sapiens
  Payload ID: 3627
  Gene Symbol: CCHCR1
  Gene Name: coiled-coil alpha-helical rod protein 1
  ENST ID: ENST00000507226
  CDS Start-End: 257-544
gcagtagggggctctcgcggttggccttgctgagccatggagagaactctggagatggcgctcaagacccctgcactgtgtacctcctttctcacctctggccaggagcagcagggaccatagaaacttaaggaggagggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcgg

SEQ ID NO: 120618 - DNA, 662 bp, Homo sapiens
  Payload ID: 3627
  Gene Symbol: CCHCR1
  Gene Name: coiled-coil alpha-helical rod protein 1
  ENST ID: ENST00000502557
  CDS Start-End: 307-662
gggggcgggaaggggctgagcgggggtcctgggagggttcaaggggtccaaaggggaagggggtacaggggccaggtgaagggacagatgaagagatcagaacagccttagagctcacgggctaactgggtgaagcctcgggtatctaggggagcagtggtgggagagtagagccggctagcgtacagggggcgagggcaggctattgagagatgggggtgagggtcaggaccagaataattccttcagaaaaaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaa

SEQ ID NO: 120619 - DNA, 861 bp, Homo sapiens
  Payload ID: 3627
  Gene Symbol: CCHCR1
  Gene Name: coiled-coil alpha-helical rod protein 1
  ENST ID: ENST00000506831
  CDS Start-End: 754-861
aagtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtagaggcactgcccagaatcctgaaagtatgagtaaagcctcagagcccctctcagtctgtctctttcagtaaattctctccacttgatagttgcttgggttccatgaggaaccaggttgagacaagcaagtgaatttggggtatctcctactttggggaagtaggaaaagagctaagcatcgggtggacctggctataattcaaggattatgactttgttattgtaggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattccc

SEQ ID NO: 120620 - DNA, 560 bp, Homo sapiens
  Payload ID: 3627
  Gene Symbol: CCHCR1
  Gene Name: coiled-coil alpha-helical rod protein 1
  ENST ID: ENST00000503934
  CDS Start-End: 142-560
aaagcgcagtagggggctctcgcggggctttctctttggaaggtggcctgaaaattgaattggagtgtctttgtttctcctcttgtccaggggaacatagatggctggagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccg

SEQ ID NO: 120621 - DNA, 511 bp, Homo sapiens
  Payload ID: 3627
  Gene Symbol: CCHCR1
  Gene Name: coiled-coil alpha-helical rod protein 1
  ENST ID: ENST00000513222
  CDS Start-End: 91-511
aaagcgcagtagggggctctcgcggttggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggagccagcggg

SEQ ID NO: 120622 - DNA, 565 bp, Homo sapiens
  Payload ID: 3627
  Gene Symbol: CCHCR1
  Gene Name: coiled-coil alpha-helical rod protein 1
  ENST ID: ENST00000512418
  CDS Start-End: 80-214
aaagcgcagtagggggctctcgcggttggggaacatagatggctggagacagaatctagagccttcaaataatgtggagatgtttccaccttcaggccatcaagatgtctcagagaggcggctagacacccagagacctcaagtgaccatgtgggaacgggatgtttccagtgacaggcaggagccagggcggagaggcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtgccttctgaggtccacagccagacatgggaactggagcgacagaagcttctggaaaccatgcagcacttgcaggaggaccgggacagcctgcatgccaccgcggagctgctgcaggtgcgggtgcaga

SEQ ID NO: 120623 - DNA, 2954 bp, Homo sapiens
  Payload ID: 3627
  Gene Symbol: CCHCR1
  Gene Name: coiled-coil alpha-helical rod protein 1
  ENST ID: ENST00000610825
  CDS Start-End: 190-2802
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggcagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggtggctggaggaggaggtctggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgttggtggcagcagcagacagcctcagccgaggagcagttgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctgcaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagg

SEQ ID NO: 120624 - DNA, 2954 bp, Homo sapiens
  Payload ID: 3627
  Gene Symbol: CCHCR1
  Gene Name: coiled-coil alpha-helical rod protein 1
  ENST ID: ENST00000611796
  CDS Start-End: 190-2802
gtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggggaacatagatggcagacagaatctagagccttcaaataatgtggagatgtttccaccttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgagcaagacccaggaagacttggaggctcaggtgaccctggttgagaatctaagaaaatatgttggggaacaagtcccttctgaggtccacagccagacatgggaactggagcgacagaagcttctggacaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctcactccaggaaaaagtgacatcccagagccaggagcaggccatcctgcagcgatccctgcaggacaaagccgcagaggtggaggtggagcgtatgggtgccaagggcctgcagttggagctgagccgtgctcaggaggccaggcgtcggtggcagcagcagacagcctcagccgaggagcagctgaggcttgtggtcaatgctgtcagcagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaagg

SEQ ID NO: 120625 - DNA, 2954 bp, Homo sapiens; identical to SEQ ID NO: 120624
  Payload ID: 3627
  Gene Symbol: CCHCR1
  Gene Name: coiled-coil alpha-helical rod protein 1
  ENST ID: ENST00000622518
  CDS Start-End: 190-2802

SEQ ID NO: 120626 - DNA, 2954 bp, Homo sapiens; identical to SEQ ID NO: 120623
  Payload ID: 3627
  Gene Symbol: CCHCR1
  Gene Name: coiled-coil alpha-helical rod protein 1
  ENST ID: ENST00000613123
  CDS Start-End: 190-2802

SEQ ID NO: 120627 - DNA, 3581 bp, Homo sapiens
  Payload ID: 3628
  Gene Symbol: CC2D1A
  Gene Name: coiled-coil and C2 domain containing 1A
  Uniprot ID: Q6P1N0
  ENST ID: ENST00000318003
  CDS Start-End: 242-3097
gtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactca

SEQ ID NO: 120628 - DNA, 2743 bp, Homo sapiens
  Payload ID: 3628
  Gene Symbol: CC2D1A
  Gene Name: coiled-coil and C2 domain containing 1A
  ENST ID: ENST00000586955
  CDS Start-End: 1-1136
gacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactca

SEQ ID NO: 120629 - DNA, 1667 bp, Homo sapiens
  Payload ID: 3628
  Gene Symbol: CC2D1A
  Gene Name: coiled-coil and C2 domain containing 1A
  ENST ID: ENST00000587508
  CDS Start-End: 1-1217
cccaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacagttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggcc

SEQ ID NO: 120630 - DNA, 3117 bp, Homo sapiens
  Payload ID: 3628
  Gene Symbol: CC2D1A
  Gene Name: coiled-coil and C2 domain containing 1A
  Uniprot ID: Q6P1N0
  ENST ID: ENST00000589606
  CDS Start-End: 1-2853
atgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacagttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctct

SEQ ID NO: 120631 - DNA, 3377 bp, Homo sapiens
  Payload ID: 3629
  Gene Symbol: CC2D1B
  Gene Name: coiled-coil and C2 domain containing 1B
  Uniprot ID: Q5T0F9
  ENST ID: ENST00000284376
  CDS Start-End: 126-2684
cacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgta

SEQ ID NO: 120632 - DNA, 5642 bp, Homo sapiens
  Payload ID: 3629
  Gene Symbol: CC2D1B
  Gene Name: coiled-coil and C2 domain containing 1B
  Uniprot ID: Q5T0F9
  ENST ID: ENST00000371586
  CDS Start-End: 140-2716
tgttgcgcgcgagccacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacatgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagcctcctgggcacctgcagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgtagacacgtttatttatctaggaaactaagtctaactcattgtagggattttatactcaactatacagagtatccaccaaagtcctaatctaaagtcctgctccctgtcactttttaaaagccagggtagcagtaacatgacaaacggctgctgtggcttcctcttgagagaggacagggaaagcctttcctcttcggctggttatgtggggaacttccttagtttttttccacaagaaattctcctttggctttgtttttctgaatggatggagactatgaaggggtttgtagttgtaagagatttaatattcaaaactgaaatattctgcatttcttagaaataccccatcttcccccaccccctttttgaattattaattcaagatcaacaaagcattcctcaagatcacttttaaaaaaggttagaagtgaagcaaatacattcagcttactgatcactatagtattgcataagcacagctcaagaactgagctttgtatgtgtccttttgggggataacagggctggaccatgcttccctgcccttaaacgcagagcttttagtgggtcacagagcgggaactacacacaagtgacttttttccccatgagccctctggccgattttttttttttttttttttttgagacagagtagctctctgccagccaggctggagtgcagtggcatgatctcagctcgctgcaacccccacctcccaggttcaagcgattctcctgtgtcagtctcctgagtagctgggattacaggcacccaccactatgcccagctaatttttttatttttagtagagacggtgtttcaccatgttggtcaggctggtctcgaactcctgacctcatgatccacccacctcagcctcccaaagtgctgggattacaggtgtgagccaccgcacccggctggccaatcttatcagaagtgagctaccaaaacttccacagatgtgagatttaacacttaattgcagtcacgtgtatgcaacacagcaataatctagaatgaaaaggagggtgattagccttcataagatgacctatagagcaaagaaaggtgactggaagggttcctaacccaacctactccccttagggtgtgtatccaacccagtgcttcctaagagggttacggaccactgtggttatcctctaaagttccagccagctctaggagtttctaaattcaggcctctgttggaaatggcctatttcgatagatagaaagttttctatagctctaaaggtttctcctttgcaacccattcaatttcagtctgctgctttgctctttcaaaacagaacctccaggctgacgaggcaagacaaagcctcccaccagacttggagattgaagttcttaaaaggcctttgttgtagccaaaggcatgcatgcgtcactggtagtaggaggagcctgtcccagcttcatcttgtcctgagatttatccacatacaggaaacaggcgggacacagtggctcacgcctgtaatcccaccactttggaaagctgaggcaggtggatcacctgaggtcaggaattcaagaccagcctggccaacatggtgaaaccccgtctccactaaaaacaaaaacaattagctgggcatggtggccggcgcctgtaatcccagctactagggaggctgagacacacgaatcccttgagcccaggaagcagaggttgcagtgagcctcgattgtaccactgcactccagcctgggcgacagagcaagactctgtctcaaaacaaacacaaatacagtatccaaacattggagattagtgactcacctgcagttgggagccagctacaacccaaatcattttaaaattttcaattctttgatctcatgcaatgcacactttcttctgaattagcaaactgaataaactacagaaattttttagaatcaa

SEQ ID NO: 120633 - DNA, 2521 bp, Homo sapiens
  Payload ID: 3629
  Gene Symbol: CC2D1B
  Gene Name: coiled-coil and C2 domain containing 1B
  ENST ID: ENST00000438021
  CDS Start-End: 1-1886
gaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattt

SEQ ID NO: 120634 - DNA, 2018 bp, Homo sapiens
  Payload ID: 3629
  Gene Symbol: CC2D1B
  Gene Name: coiled-coil and C2 domain containing 1B
  ENST ID: ENST00000450942
  CDS Start-End: 1-2018
ccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtga

SEQ ID NO: 120635 - DNA, 4488 bp, Homo sapiens
  Payload ID: 3630
  Gene Symbol: CC2D2A
  Gene Name: coiled-coil and C2 domain containing 2A
  ENST ID: ENST00000389652
  CDS Start-End: 1-4361
aggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagttctgaaggctcaggcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagatgagtaacatgcttaagaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaa

SEQ ID NO: 120636 - DNA, 1673 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000438599
  CDS Start-End: 255-623
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctaaccggactttaggctgcaacattgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaattt

SEQ ID NO: 120637 - DNA, 5249 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000424120
  CDS Start-End: 255-5117
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctaaccggactttaggctgcaacattgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 120638 - DNA, 5175 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000503292
  CDS Start-End: 181-5043
gcccaggggcatctccaacactcagcctttccctccggacccttttaaaagattcaacagcaccgtctctctccacttccatcctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 120639 - DNA, 1949 bp, Homo sapiens
  Payload ID: 3630
  Gene Symbol: CC2D2A
  Gene Name: coiled-coil and C2 domain containing 2A
  ENST ID: ENST00000512702
  CDS Start-End: 186-1949
tttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaa

SEQ ID NO: 120640 - DNA, 3259 bp, Homo sapiens
  Payload ID: 3630
  Gene Symbol: CC2D2A
  Gene Name: coiled-coil and C2 domain containing 2A
  ENST ID: ENST00000506643
  CDS Start-End: 1-2711
aactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatgcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaa

SEQ ID NO: 120641 - DNA, 1474 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000515124
  CDS Start-End: 165-500
gcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaa

SEQ ID NO: 120642 - DNA, 1663 bp, Homo sapiens
  Payload ID: 3630
  Gene Symbol: CC2D2A
  Gene Name: coiled-coil and C2 domain containing 2A
  ENST ID: ENST00000511544
  CDS Start-End: 186-407
tttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacaggcagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaatttatctcatatggctgtttctttttctaaatgctcaaaattatttattactaccaaa

SEQ ID NO: 120643 - DNA, 605 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000503658
  CDS Start-End: 98-466
ctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaa

SEQ ID NO: 120644 - DNA, 548 bp, Homo sapiens
  Payload ID: 3630
  Gene Symbol: CC2D2A
  Gene Name: coiled-coil and C2 domain containing 2A
  Uniprot ID: Q9P2K1
  ENST ID: ENST00000507954
  CDS Start-End: 208-543
gacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcac

SEQ ID NO: 120645 - DNA, 425 bp, Homo sapiens
  Payload ID: 3630
  Gene Symbol: CC2D2A
  Gene Name: coiled-coil and C2 domain containing 2A
  ENST ID: ENST00000514039
  CDS Start-End: 1-425
ttgatacattctgtcccttgaaaaatgtgggctgtttaataggtcctgacaatcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccatacccc

SEQ ID NO: 120646 - DNA, 4790 bp, Homo sapiens
  Payload ID: 3630
  Gene Symbol: CC2D2A
  Gene Name: coiled-coil and C2 domain containing 2A
  ENST ID: ENST00000634028
  CDS Start-End: 1-390
aagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgtt

SEQ ID NO: 120647 - DNA, 1809 bp, Homo sapiens
  Payload ID: 3631
  Gene Symbol: CC2D2B
  Gene Name: coiled-coil and C2 domain containing 2B
  Uniprot ID: Q6DHV5
  ENST ID: ENST00000344386
  CDS Start-End: 165-1133
tacaatatcacctttcttatagattcgcatatacatggccaaaggaacaactccatgttttctaaaaggcctagagaacatacatcagctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtctggtttaatattcaacaaaataatacaccaatggctgtattttttgactattcaaaggaaagtttctggaagcagttgcttccaaaaaacgttcaaggaacaaaaatacaaagcatacaggtcacgggatttcccatccagatgccatacattgatgtacagtcaattattgatgctgtttatcaaactggaattcactctgctgaatttccccagacagaatttgctttagctgtatacattcacccatacccaaacaacatattatctgtgtgggtctatttggcttccttagttcaacatcaatgaaaaggaagcagagcaaagtaaaagattgtactatagtcctctagtaccaacaaaaacttttctggtaccttgagattttgctgtttattctcaagtccagctaagtgctgggcccaatttttgattcacttacagagctgggcactatggagactcgcacccctgagtgagtctttgaggaggagtctagatgagcttctcaccagagacctctccaggaaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttgaaaatgcagattactagatcctcctcaagacccactgaatcagcacctctgggagtgaagctacagactctgcattattttcaacaagctccccagataattctgatgcactgttatgagggagagcccagccttatagaatgttgtcactactaaactaaggctggtacgtttgatgctgggtctgatacaatttcagatggaagctgctcgagtggaaaactaaggtcattgcctctcatggataaaatgttatttcactggtaaagaaaaataaaataaaatctaccatgttgggctga

SEQ ID NO: 120648 - DNA, 1792 bp, Homo sapiens
  Payload ID: 3631
  Gene Symbol: CC2D2B
  Gene Name: coiled-coil and C2 domain containing 2B
  Uniprot ID: Q6DHV5
  ENST ID: ENST00000410012
  CDS Start-End: 212-1417
attctcttgatgtctacaatatcacctttcttatagattcgcatatacatggccaaaggaacaactccatgttttctaaaaggcctagagaacatacatcagaagttttaaactgtaccagtcctttcctttatgctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtctggtttaatattcaacaaaataatacaccaatggctgtattttttgactattcaaaggaaagtttctggaagcagttgcttccaaaaaacgttcaaggaacaaaaatacaaagcatacagcctgaagaaataatttattttgaaactgataaaagcatggtagaagatctaaggaataggatcgaaaggactctgaagagtaaagtgatggaatggcgacctaaacacccaacacattggaatcgacagtgtacttttattttgcgacaaatccttcctaagctggaatttggcataggaagctttgtttcatctgaaggagataatgaatttgaaagaatactacaattttattgggtcacgggatttcccatccagatgccatacattgatgtacagtcaattattgatgctgtttatcaaactggaattcactctgctgaatttccccagacagaatttgctttagctgtatacattcacccatacccaaacaacatattatctgtgtgggtctatttggcttccttagttcaacatcaatgaaaaggaagcagagcaaagtaaaagattgtactatagtcctctagtaccaacaaaaacttttctggtaccttgagattttgctgtttattctcaagtccagctaagtgctgggcccaatttttgattcacttacagagctgggcactatggagactcgcacccctgagtgagtctttgaggaggagtctagatgagcttctcaccagagacctctccaggaaggacctttggatagtctggctttcttgggtcactgtctgcagtaggtcttattctgggaaagaagcaattttggcctcttctcctaagaccaatgtttctcaaattgtagaattcacaccacctccatttgaatcatctggagagccttgttga

SEQ ID NO: 120649 - DNA, 818 bp, Homo sapiens
  Payload ID: 3631
  Gene Symbol: CC2D2B
  Gene Name: coiled-coil and C2 domain containing 2B
  ENST ID: ENST00000424464
  CDS Start-End: 233-818
attcctttttaaacaatatccattctcttgatgtctacaatatcacctttcttatagattcgcatatacatggccaaaggaacaactccatgttttctaaaaggcctagagaacatacatcagaagttttaaactgtaccagtcctttcctttatgctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagattagtggaacatttcaagtaactattccaccagttttgctcgggtatacttggagtaatacttatgtatttcctaaagaagattccaatgagcagaatttaaaagaatgtacattcttaaatatttttgctaccattgaacctcaaatatcatatgtcacctgtaatccaacactagataagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacat

SEQ ID NO: 120650 - DNA, 2463 bp, Homo sapiens
  Payload ID: 3632
  Gene Symbol: CCDC102A
  Gene Name: coiled-coil domain containing 102A
  Uniprot ID: Q96A19
  ENST ID: ENST00000258214
  CDS Start-End: 248-1900
ccctccctcggcccctccggcggcggtcgcagctgcacggtgcccgctctaccccgccgcagcggctgggacgtacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgccggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttcttggggcatctgaaagtatggcagatgtgggcgggggttgtgggggacggcatcggcctgcacctgacgctgaaccagagctcaggaatgtcaagtaacttaataaatgagtgaatgtgaagaa

SEQ ID NO: 120651 - DNA, 2644 bp, Homo sapiens
  Payload ID: 3633
  Gene Symbol: CCDC102B
  Gene Name: coiled-coil domain containing 102B
  Uniprot ID: Q68D86
  ENST ID: ENST00000319445
  CDS Start-End: 51-1592
agaacttggcaggatgaagacaaagtgtgtgaaaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtc

SEQ ID NO: 120652 - DNA, 673 bp, Homo sapiens
  Payload ID: 3633
  Gene Symbol: CCDC102B
  Gene Name: coiled-coil domain containing 102B
  ENST ID: ENST00000358653
  CDS Start-End: 226-645
ggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaatttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggatgtaaaataacgttcatgcatctgaaacaaagtgtgtc

SEQ ID NO: 120653 - DNA, 2711 bp, Homo sapiens
  Payload ID: 3633
  Gene Symbol: CCDC102B
  Gene Name: coiled-coil domain containing 102B
  Uniprot ID: Q68D86
  ENST ID: ENST00000360242
  CDS Start-End: 118-1659
aggactccagaactgtacggatgagaaaaggatgcaggaaattctgttgtttacacatgtggctgcaactgagacactggagcagcccagcaagcccagagggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaatgaaatcttactaattcattattgaataaagaccacttttatcagagtc

SEQ ID NO: 120654 - DNA, 537 bp, Homo sapiens
  Payload ID: 3633
  Gene Symbol: CCDC102B
  Gene Name: coiled-coil domain containing 102B
  ENST ID: ENST00000578970
  CDS Start-End: 261-537
ggtgcccccctccacgcccaggagcgtgggaaccctgcttaagggctttactagggaaaacggtgctggttcactggggcgcgtttccgggaaggtgaataccggtgaaagttatgctgagggtgagtaaactcaaaaactgacactcgattcagctattggaaagtttttttaatgtggttggaacaactgagaattccgaattccaagaacctggacaacttgccgtcaagactttccatcaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgc

SEQ ID NO: 120655 - DNA, 465 bp, Homo sapiens
  Payload ID: 3633
  Gene Symbol: CCDC102B
  Gene Name: coiled-coil domain containing 102B
  ENST ID: ENST00000581520
  CDS Start-End: 54-465
tgtctttaaaaaataactgtatactaagcaaaactcaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactga

SEQ ID NO: 120656 - DNA, 1554 bp, Homo sapiens
  Payload ID: 3633
  Gene Symbol: CCDC102B
  Gene Name: coiled-coil domain containing 102B
  Uniprot ID: Q68D86
  ENST ID: ENST00000584156
  CDS Start-End: 1-1452
atgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgaggtactactttatgagtgaacacgtgctggacagcttctaaatagtattttagagcatatctaaagattgtctcccttattaacatatggcattaatgggatataaatattcatatcttaa

SEQ ID NO: 120657 - DNA, 541 bp, Homo sapiens
  Payload ID: 3633
  Gene Symbol: CCDC102B
  Gene Name: coiled-coil domain containing 102B
  ENST ID: ENST00000582371
  CDS Start-End: 170-541
aagggctttactagggaaaacggtgctggttcactggggcgcgtttccgggaaggtgaataccggtgaaagttatgctgagggtgagtaaactcaaaaactgacactcgattcagctattggaaagtttttttaatgtggttggaacaactgaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcaga

SEQ ID NO: 120658 - DNA, 1179 bp, Homo sapiens
  Payload ID: 3633
  Gene Symbol: CCDC102B
  Gene Name: coiled-coil domain containing 102B
  ENST ID: ENST00000584775
  CDS Start-End: 203-1179
aagggctttactagggaaaacggtgctggttcactggggcgcgtttccgggaaggtgaataccggtgaaagttatgctgagggtgagtaaactcaaaaactgacactcgattcagctattggaaagtttttttaatgtggttggaacaactgagaacttggcaggatgaagacaaagtgtgtgaaaggtcttaaaaataaatatgaatttagattccatacatcgattaattgaggaaacacagatcttccagatgcaacaatcatcaattaagtcacgcggcgacatggtggcacctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaaagttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaaga

SEQ ID NO: 120659 - DNA, 849 bp, Homo sapiens
  Payload ID: 3634
  Gene Symbol: CCDC103
  Gene Name: coiled-coil domain containing 103
  ENST ID: ENST00000357776
  CDS Start-End: 138-849
gctaggcaaccacagctgcgggcgtggtctgcgcggggttgccctcctgttctggtttatcaggggatccccaaagaaagcaaggggaccaaggccgggactgctggggtgaaggtccgggaggctgagcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagc

SEQ ID NO: 120660 - DNA, 571 bp, Homo sapiens
  Payload ID: 3634
  Gene Symbol: CCDC103
  Gene Name: coiled-coil domain containing 103
  Uniprot ID: Q8IW40
  ENST ID: ENST00000410027
  CDS Start-End: 131-427
gtggtctgcgcggggttgccctcctgttctggtttatcaggggatccccaaagaaagcaaggggaccaaggccgggactgctggggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccgaacagctggaagagctcctgactccctttccttcctttgtggtccaggagaaagcccccctccagcccgagacgtctgctgacttctatcgtgattggcgacgacacttgccaagtgggccagagcgctaccaggctctactgcagcttgggggtccaaggctcg

SEQ ID NO: 120661 - DNA, 921 bp, Homo sapiens
  Payload ID: 3634
  Gene Symbol: CCDC103
  Gene Name: coiled-coil domain containing 103
  Uniprot ID: Q8IW40
  ENST ID: ENST00000410006
  CDS Start-End: 128-856
agttgctaggcaaccacagctgcgggcgtggtctgcgcggggttgccctcctgttctggtttatcaggggatccccaaagaaagcaaggggaccaaggccgggactgctggggtgaaggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttggg

SEQ ID NO: 120662 - DNA, 3397 bp, Homo sapiens
  Payload ID: 3634
  Gene Symbol: CCDC103
  Gene Name: coiled-coil domain containing 103
  Uniprot ID: Q8IW40
  ENST ID: ENST00000417826
  CDS Start-End: 96-824
atcaggggatccccaaagaaagcaaggggaccaaggccgggactgctggggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaggatgtggccactgaaatctccccggagaaagcccccctccagcccgagacgtctgctgacttctatcgtgattggcgacgacacttgccaagtgggccagagcgctaccaggctctactgcagcttgggggtccaaggctcggctgcctcttccagacagatgtgggatttggacttcttggggagctgctggtggcactggctgatcacgtggggccggctgaccgggcagcggtgctggggatcctatgcagcctggcgagcactgggcgcttcaccctgaacctaagcctgctgagccgggcagagagagagagctgcaagggcttgtttcagaagctgcaagccatgggcaaccccagatccgtgaaggaggggctcagctgggaggagcagggtctggaggagcagtctggtgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 120663 - DNA, 576 bp, Homo sapiens
  Payload ID: 3634
  Gene Symbol: CCDC103
  Gene Name: coiled-coil domain containing 103
  ENST ID: ENST00000577339
  CDS Start-End: 399-576
ggcagccccgaaatcgaggtgtgtgcgtgtgtgcgcgcttcggaagccttgggaaggcacgaggacgacagggtcttccattctttttcccgctccaggcctcaatttaccgatccgtaaagcgaaaggggccaatagcatataaggccccttccagatctgacgctttttaatttcctatcccacctggagcaacccttccgtgccgctgacccgcttcaacttacctctcgcctgctcagctaagagttcccaggccgctgccggagatcgtgcttccgccccacgccgaggaaacgcctgcgcccgccgccaggaaggaccccgcagacgccgctgtcgcctttctgcccgggaggacaaccctctgcctgaggaccagttccgaggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactgg

SEQ ID NO: 120664 - DNA, 1732 bp, Homo sapiens
  Payload ID: 3635
  Gene Symbol: CCDC105
  Gene Name: coiled-coil domain containing 105
  Uniprot ID: Q8IYK2
  ENST ID: ENST00000292574
  CDS Start-End: 83-1582
gccaggaaagagttgtgtgtctttggggtcccttccgctccgcctagggttcccggccaggccgagagaccaagcagggaccatgcgcgtgttggtacccccggctgagcgcagccaggacacacgcgttggggccccagcatggcgcgaggcagctcaggccatggcgaggaccgcgcacattctgaccgatcgctgcgggcaggaggcggtgaccatgtggcagcccaaggacagcgtgctggacccgaacgtggcccaccacctcggccgcgccgcctacatccagccctggcgcttccgcgtggagatgatcaaaggcggcggcaccttggagaagccgccgccaggcgagggcgtcacgctgtggaagggcaagatgaagccgcccgcctggtacgcccgcctgccgctacccttgcaccgcaaagcgcgcgccctgcagaccaccgaggtggtgcacgcgcacgcgcgtggagcgcgcctcaccgccgcccgcctcggccgcgcgcagcaccagattaacgggcgggtgcgacagctgctgcgccagcgcgaggtcaccgaccacaggctcagcgaagtgcgcaagggtctgcttattaaccagcagagcgtcaagctgcggggctacaggcccaagtctgagaaggtccctgacaaagctgacagtatgcttacatgggagaaagaggagctgaaaagcatgaagaggaaaatggagagagatatggaaaaatcagaggtcctactcaagaccctggcctcctgccgagacactctgaacttctgcttcaaggagcggctccaagccgtggacctcatgaaccagcctctggacaaggttctggagcaggccagacgccactcatgggtgaacctctcccgagcccccactccacgcacacagggtcagaaaacgcctcctccagaccctgtgggcacctataacccagcgtgcgccttggcgctaaacgaagccaagcggttgttggtcgagtccaaggacaccttggtagaaatggcaaagaacgaggtggacgtccgggagcaacagctgcagataagcgaccgtgtgtgtgcctcgctggcgcagaaggcgagcgagaccttggagctgaaggaaagattaaatatgacgttaggactgatgaggggaactatcctccggtgtacgaaatataaccaagagttgtacaccacccacggtctcatcaagggtcctctgtcgaaagttcacctggagaccgcagaaaagctggacagacccctggttcgcatgtaccagagacacgtgggcacccaactcccggaggctgcgcgcctcgcacagggcaccgacaagctgcagtgccacatcacgtacctggaaaagaacctggacgagctgctcgccacgcacaagaacctcagctggggcctcaactgcaagaacatcgggcatgaggtggacggcaacgtggtgcgcctgcgcctgcgccagcggcaaccgcacgtgtgctacgagcaggcgcagcgcctggttaaggactgggacccgcgcacgccgccgccgcgcagcaagagcagcgcggacccctagtgaccccagcgtcccccgccccagccagctgattggatgctggctgggacctcggagagcagacacagccccatggccctccctctcccctgacgcaccctccctccaagcaccctctaggagaattataattaaaaataacaataatta

SEQ ID NO: 120665 - DNA, 1546 bp, Homo sapiens
  Payload ID: 3636
  Gene Symbol: CCDC106
  Gene Name: coiled-coil domain containing 106
  Uniprot ID: Q9BWC9
  ENST ID: ENST00000308964
  CDS Start-End: 289-1131
aacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaa

SEQ ID NO: 120666 - DNA, 2162 bp, Homo sapiens
  Payload ID: 3636
  Gene Symbol: CCDC106
  Gene Name: coiled-coil domain containing 106
  Uniprot ID: Q9BWC9
  ENST ID: ENST00000586790
  CDS Start-End: 905-1747
acgctcccctgccgccccgcctgttcgcgggtgggtgggcgcttccctcggctccccgtgacactttgcagacgctccccggcgccgggcatgggcgccgccgccgtcggtccccgagccggattccgcgagcgggtgggtgagcgcggggggcctcggcccctcggaccccgggcacccgcgggcgggggatggtggccgcgtttgcacccccgccctagtgcatgttcccgctggaatcgttccacgaccgctccccctcccacccgcgggacaaagggcgggggcggggggggcgcacccccacgcgtgacctttccccgtactgcgcacgcgcccagcccccaccaccgggggacggtccgcccgcccacgcgagtgcgggggaggggtgtgggggccccgaaggtagaggaggcagcgcgcacgggctggacctcctcctaccctgggaagttggggcagtttccccctgcacctgcctcttccttaggcctggcagtggcccgcgatgagagagggtccttccccttcaggctaggtgtccctggtcaggcgaccccttggggcacccagcaatttagggcttcagcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaa

SEQ ID NO: 120667 - DNA, 1153 bp, Homo sapiens
  Payload ID: 3636
  Gene Symbol: CCDC106
  Gene Name: coiled-coil domain containing 106
  ENST ID: ENST00000591241
  CDS Start-End: 129-866
cctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaaagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagacc

SEQ ID NO: 120668 - DNA, 741 bp, Homo sapiens
  Payload ID: 3636
  Gene Symbol: CCDC106
  Gene Name: coiled-coil domain containing 106
  ENST ID: ENST00000592996
  CDS Start-End: 224-741
cggcgccgccggcccggagctgcccggaagtctcggttccgccgccggcgctcgccaggggaagcccggggccgcccgggacctcggcccgttcctccggacccgagaggccgccgcacggggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagag

SEQ ID NO: 120669 - DNA, 1592 bp, Homo sapiens
  Payload ID: 3636
  Gene Symbol: CCDC106
  Gene Name: coiled-coil domain containing 106
  Uniprot ID: Q9BWC9
  ENST ID: ENST00000591578
  CDS Start-End: 335-1177
atgggcgccgccgccgtcggtccccgagccggattccgcgagcgggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaa

SEQ ID NO: 120670 - DNA, 626 bp, Homo sapiens
  Payload ID: 3636
  Gene Symbol: CCDC106
  Gene Name: coiled-coil domain containing 106
  ENST ID: ENST00000587213
  CDS Start-End: 510-626
ggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccc

SEQ ID NO: 120671 - DNA, 552 bp, Homo sapiens
  Payload ID: 3636
  Gene Symbol: CCDC106
  Gene Name: coiled-coil domain containing 106
  ENST ID: ENST00000593069
  CDS Start-End: 417-552
agaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggaccaggggtccaggccagaaggtccctcctgtctcacttcacctcccccaggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgagg

SEQ ID NO: 120672 - DNA, 1404 bp, Homo sapiens
  Payload ID: 3636
  Gene Symbol: CCDC106
  Gene Name: coiled-coil domain containing 106
  Uniprot ID: Q9BWC9
  ENST ID: ENST00000588740
  CDS Start-End: 147-989
atgggcgccgccgccgtcggtccccgagccggattccgcgagcgggatggaccctccagtccatctgcgtctctccatttgtggctgccgtttctgtccagtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaa

SEQ ID NO: 120673 - DNA, 804 bp, Homo sapiens
  Payload ID: 3637
  Gene Symbol: CCDC107
  Gene Name: coiled-coil domain containing 107
  Uniprot ID: Q8WV48
  ENST ID: ENST00000327351
  CDS Start-End: 64-531
cggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtct

SEQ ID NO: 120674 - DNA, 1016 bp, Homo sapiens
  Payload ID: 3637
  Gene Symbol: CCDC107
  Gene Name: coiled-coil domain containing 107
  ENST ID: ENST00000378406
  CDS Start-End: 67-480
gggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 120675 - DNA, 899 bp, Homo sapiens
  Payload ID: 3637
  Gene Symbol: CCDC107
  Gene Name: coiled-coil domain containing 107
  Uniprot ID: Q8WV48
  ENST ID: ENST00000378407
  CDS Start-End: 77-496
gtgcgcgttggggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatg

SEQ ID NO: 120676 - DNA, 1173 bp, Homo sapiens
  Payload ID: 3637
  Gene Symbol: CCDC107
  Gene Name: coiled-coil domain containing 107
  Uniprot ID: Q8WV48
  ENST ID: ENST00000378409
  CDS Start-End: 91-861
ctgctcgcgtgcgcgtgcgcgttggggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatcccttttctcatagcaaaactgagacagaagggtctttcccaaaaaaaagaaaaaaaactttactcaaatccagtggaaaaataaatgatagaaactatac

SEQ ID NO: 120677 - DNA, 1324 bp, Homo sapiens
  Payload ID: 3637
  Gene Symbol: CCDC107
  Gene Name: coiled-coil domain containing 107
  Uniprot ID: Q8WV48
  ENST ID: ENST00000421582
  CDS Start-End: 64-423
cggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcaggtgggtttagcagaagtctgtgctgggtcgggggagtttaggggacagcagaagatacataaccacttctgcccccttttttcccttatccccagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatccctt

SEQ ID NO: 120678 - DNA, 1242 bp, Homo sapiens
  Payload ID: 3637
  Gene Symbol: CCDC107
  Gene Name: coiled-coil domain containing 107
  Uniprot ID: Q8WV48
  ENST ID: ENST00000426546
  CDS Start-End: 67-918
gggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatgatggagtgctcctgtgtgttttttcgatcctagttggttgtacacacccatactaggtgcctaaggacaactgggccttcttgaagagctgtccttattaggacaaaaagaggctgccttccagtgtgacagcagagaagatagagggagctccagctcttttcctcgtattcctgaggccaccagcatgcccgcgttcagggcccaaaaatcccttttctcatagcaaaactgagacagaagggtctttcccaaaaaaaagaaaaaaaactttactcaaatccagtggaaaaataaatgatagaaactatacacaacataaaaa

SEQ ID NO: 120679 - DNA, 2259 bp, Homo sapiens
  Payload ID: 3638
  Gene Symbol: CCDC108
  Gene Name: coiled-coil domain containing 108
  Uniprot ID: Q6ZU64
  ENST ID: ENST00000295729
  CDS Start-End: 125-619
gtcctgtatctatggagacggcaatatggaggcgatcttacatttctttgatttcatctgaacgtccagttcacaattggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggtaccagtataagggatcaaggacccagtgccacagccttgagccccgaaagcaggctctcttcaaaacaaaacaaaacaaacaaaaaaaacctttaacatgccatataaaagccagtgagtgtttaaaatacgtgcagtatgaataattatgcagctataatccattatttttcattgtggtatagtgtcccaatgtgtgcctgtaccataatgtattcatccagaatgaaggaagtttgggctgtttctatttgggactgttggcattcgtgtatatgtgtccagttacataagtacaagagtttttctggggaataccaggtactatgaaggctcacgtgattttggagtcttatgaaggttttttttttttttttcctgcgtagttgttaaattggtgaccttgcgggatggaaccttctattccaccaccttgctccaccttctgtcttttctggggaatagacgcaggagtagaattgcggaggcttgggccatgtacctgttcacttgctgtagataaaccaaactatttcccaaagtgcatggatttctttagacacccaccagcagcattagagagttcccattcctccacatccttaccaataactgctattgtcagaatttaaaatttttgccagtaatggtaacttgtggttttaatttgcatttccctgattactaatgaatgaggatgagtgtctttttgtaggttattgacactttgcatttcttcatgtgtgaaatttatgatcaagtctgtggccatttttctcttacattatcttgtcttttttctttttggtataagttcttatcccaattacaaactctttgccagttatgcgttgtggatatcttctctcatcttatgatttgtctttactccctttattgtgtcttttgaagaataaaagttcaaagttgaattttaaaggtatcaactttatcagtctttttattttatgattggtgcttttttatgcttctcctaagaagtccttctctacccctaggtcattaagatattttcctctagtatcttctaaagactttatatttttgccttttatatttgtcttttgtctatatggaattgatttttatgaatagtaagtcttgatagctggtagtatacgtcctcctacttaattcttcttcaagattgtcttggctattcttggccctccctttgatctcttacataaatattcaaatcagcttatcatacatgcacataaaacacttcttgagattttgattgggatttaattggacctatagatgaatatgaggagaaatgatatcattataatattgagtcttttactccatgaacatgggctatttctgtattcattaggttatctttcctgtctctcaatagagtgtaaagttttctccatagacatttagcacatccttagttagatttattcataagtattttatatttttgctgttgttatatatgacatattttttagttgttttatttctgtttgttgctagtttttaaaatgtcatttttatataggtattatgttcagtgatcttggcaaatcctcttattctaataatttatttgttaattttcttgttttttcatgcacacatttgtattttaaatggaaaatgacatttttttttctttctagtccttacacctttggctttccttactgcattgttaaatagaaaagtgttgaacagaagtggttatagaggcatctttgttttgtttatcatctcagagtaaaggactgcaatgtttcactattaa

SEQ ID NO: 120680 - DNA, 5953 bp, Homo sapiens
  Payload ID: 3638
  Gene Symbol: CCDC108
  Gene Name: coiled-coil domain containing 108
  Uniprot ID: Q6ZU64
  ENST ID: ENST00000341552
  CDS Start-End: 85-5862
gtcctgtatctatggagacggcaatatggaggcgatcttacatttctttgatttcatctgaacgtccagttcacaattggagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttttttctgta

SEQ ID NO: 120681 - DNA, 2703 bp, Homo sapiens
  Payload ID: 3638
  Gene Symbol: CCDC108
  Gene Name: coiled-coil domain containing 108
  Uniprot ID: Q6ZU64
  ENST ID: ENST00000410037
  CDS Start-End: 118-2310
atctatggagacggcaatatggaggcgatcttacatttctttgatttcatctgaacgtccagttcacaattggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgagtggcttggtggggtggcaggaagtgaccgagggcagcttcaggctccatcctctgcgtgccaggctttctcttggctggacagtgacccctatgagtttgtctcctccaaagctcctggcctagctcggcccatctgattttctcattcttatgtaagtctcccctcccctccaagggagaactcagctgagatcaagctgtttgggaaaactgggtgcacagggagatactccctggggctcctggctaggaggcctcctagcttctctactagtccttgaattaagaagtggtcactctaaaggagctttgagcgggcaggaagctgggcctagagacaaagtcagcagcaccagataattgtgatggaaagggcttctgactcagcttccctgggtcgggaactccgagtgccggctgtccccagccctgctgttctggccccagatgcgtggtgccccctcctcatccgttagtcctgcccatcccttccttcttgactctgcccaccccact

SEQ ID NO: 120682 - DNA, 2769 bp, Homo sapiens
  Payload ID: 3638
  Gene Symbol: CCDC108
  Gene Name: coiled-coil domain containing 108
  Uniprot ID: Q6ZU64
  ENST ID: ENST00000409865
  CDS Start-End: 5-2359
atctatggagacggcaatatggaggcgatcttacatttctttgatttcatctgaacgtccagttcacaattggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgagtggcttggtggggtggcaggaagtgaccgagggcagcttcaggctccatcctctgcgtgccaggctttctcttggctggacagtgacccctatgagtttgtctcctccaaagctcctggcctagctcggcccatctgattttctcattcttatgtaagtctcccctcccctccaagggagaactcagctgagatcaagctgtttgggaaaactgggtgcacagggagatactccctggggctcctggctaggaggcctcctagcttctctactagtccttgaattaagaagtggtcactctaaaggagctttgagcgggcaggaagctgggcctagagacaaagtcagcagcaccagataattgtgatggaaagggcttctgactcagcttccctgggtcgggaactccgagtgccggctgtccccagccctgctgttctggccccagatgcgtggtgccccctcctcatccgttagtcctgcccatcccttccttcttgactctgcccaccccactgcccttgcccagaggcc

SEQ ID NO: 120683 - DNA, 707 bp, Homo sapiens
  Payload ID: 3638
  Gene Symbol: CCDC108
  Gene Name: coiled-coil domain containing 108
  ENST ID: ENST00000457968
  CDS Start-End: 5-707
atctatggagacggcaatatggaggcgatcttacatttctttgatttcatctgaacgtccagttcacaattggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgccccttacagccgtcatctacgaggtgcaggccacgtgctggtacggggcgggcagccggcagaggagcagcatccagctgcaggctgtgg

SEQ ID NO: 120684 - DNA, 1123 bp, Homo sapiens
  Payload ID: 3638
  Gene Symbol: CCDC108
  Gene Name: coiled-coil domain containing 108
  ENST ID: ENST00000413871
  CDS Start-End: 1-383
agaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactggtatggcttgaagggggccactggggggcctgggagacaagtgcctagaggctgaaggagaacaagagctgcactctcttgcccgtggtggcctggctgcttgctgtctgtgaagagtggacctcacattgacggctgtggaggccagggtggaactggggttgccagcaggactccgggcctgtcaccggctgagacacggtgataggctcagaagcggtgggactgccctgatggagcctgggcatagtggccttaataacttaacaaatgagacacattcactgggcatctgctgcatgccaggacctgcgctttacaagtcttttctcctccaatcctgtgggaaactcctctctagactctttcatggacagggaggctgagggtcagcaaggttaaggactcagcgaagaccattcagccatgaatggacagagccaggttcaaagctgaatttgtccagtccagagcccttgcctaccccagttagtcagcaagaagactgagttgcttctacatagtacgcactgcctcgttgctggagcccgcctgacggagccccagcttagtggaggctgggcctgaatgggggcaagttgagggtctctggtggggaaggacagggacctgctgccggggacagagctgcccccgagggtcctggctgaggggcttttctcccccagaggctcagaacttgtgcccagcaaacatcctgcttccatgcatggacttttcctccctccaccatgtgcctttgtttcctagtaaactccttttgatgacttccaa

SEQ ID NO: 120685 - DNA, 516 bp, Homo sapiens
  Payload ID: 3638
  Gene Symbol: CCDC108
  Gene Name: coiled-coil domain containing 108
  ENST ID: ENST00000436631
  CDS Start-End: 165-516
atctatggagacggcaatatggaggcgatcttacatttctttgatttcatctgaacgtccagttcacaattggaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggcccc

SEQ ID NO: 120686 - DNA, 5877 bp, Homo sapiens
  Payload ID: 3638
  Gene Symbol: CCDC108
  Gene Name: coiled-coil domain containing 108
  Uniprot ID: Q6ZU64
  ENST ID: ENST00000453220
  CDS Start-End: 10-5787
atttcagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttttttctgt

SEQ ID NO: 120687 - DNA, 3416 bp, Homo sapiens
  Payload ID: 3638
  Gene Symbol: CCDC108
  Gene Name: coiled-coil domain containing 108
  ENST ID: ENST00000441968
  CDS Start-End: 1678-2493
aaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggtaccggtgaccccaggggcctcccctggggacaggagcagcccctgctgaggattctgaagagctccttccctgctcctaggaggcggggccaccttgcctcagcctgggtgtctgctgccccctggtggccctgtggggaatcatccgtgactacctggagatcccagtcccactggcatccagtgatgctggagttctgctcaggctgccagggctctgggcctgtagcctggccctgagagtaccacctcccttcagtggaactttgtctaagatatccttggggaagctgataccccatctcctgtgtccaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgagtggcttggtggggtggcaggaagtgaccgagggcagcttcaggctccatcctctgcgtgccaggctttctcttggctggacagtgacccctatgagtttgtctcctccaaagctcctggcctagctcggcccatctgattttctcattcttatgtaagtctcccctcccctccaagggagaactcagctgagatcaagctgtttgggaaaactgggtgcacagggagatactccctggggctcctggctaggaggcctcctagcttctctactagtccttgaattaagaagtggtcactctaaaggagctttgagcgggcaggaagctgggcctagagacaaagtcagcagcaccagataattgtgatggaaagggcttctgactcagcttccctgggtcgggaactccgagtgccggctgtccccagccctgctgttctggccccagatgcgtggtgccccctcctcatccgttagtcctgcccatcccttccttcttgactctgcccaccccactgcccttgcccagaggccaaggtcttggggcccagagaaaagtagggctgtgcggtcaagatcagggtcacttaccagctatgtgaccttgggcaagttccttaatgtctctgagtcctgatcttttcatctctaaacttgggaccacgtccgatcttttgaggaggctttccaaagtggaggctttggttgcccccgtcctaatgctctggcagtggggtgatgttgaggtttgtaggaataaggttgtagatgcctggctctgctgaggttcagcctgtcagatatttaggttacaggctctagacctgcacagtccagtacagccactgacagccacacgtggctactgagcttttaatatgtggctggtcccaattgagacgtgccgtgagtgtaaaatgcaccctggatttcaagacttagtatgaaaagaatgtaaaatacctcgttactaattttatattggttatatgttaaagtgataagattttagatctgttgggttaaataaaatatactattaacatt

SEQ ID NO: 120688 - DNA, 562 bp, Homo sapiens
  Payload ID: 3638
  Gene Symbol: CCDC108
  Gene Name: coiled-coil domain containing 108
  ENST ID: ENST00000458526
  CDS Start-End: 220-562
ggcaatatggaggcgatgtaagttctgagcgttagtcccaaggtcccagggtctcagggagcggcgcgagtggccagggaagcttacatttctttgatttcatctgaacgtccagttcacaattggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagt

SEQ ID NO: 120689 - DNA, 2278 bp, Homo sapiens
  Payload ID: 3639
  Gene Symbol: CCDC109B
  Gene Name: coiled-coil domain containing 109B
  Uniprot ID: Q9NWR8
  ENST ID: ENST00000394650
  CDS Start-End: 134-1144
agccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatctttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaagtattgtttgaagttctcaactgagatttttactttttggatttttatgacttgctaatgttagaaagggcttgtatgcgtctatcaaagcaacggtggctgctgttagctaaaaatccttgtcagcttgtcccacgtttattctctatgtggaggtgaaagggtctgtgcttggcattcacttccattcttagacttaatttggaatcatccttttaaaaaaatcagagaccaggtcttgccaaatcaaactcctgggctcaagcaaccctcctgcctcaacctcccacggaatcgtcttgtcattaacttctttttttaatatgcagtagttgggagtaagatctttttatcatttatcaaaaaggcataaatgttccaccaaccataaagtatagttggtactttttgaacttcaactgaaacagtgtatataaacgattgcttttgaacctgcaaatcacaagtttcaggtatcgaagccaaaacagttaactttcttcagcctctggcagattattaacaaaacagtattattcagattctatatcatattaataagaattgaaccttgaaagtaacatctgttattctattaatgtgattgtgtgtgaatgggtctgatgactgttggactgtttgtaggaacttaacatggaagatgctgacagaatcagattttgcaggtgttcaacctatagtggctaagaattatgttttctatttcatcctcagaatgccatacaacaattctggaatgctgattttttttaaagtaggaattaaagtcatacacaaaatgtggtaattcatatgtagatgaaatattaaacatttaaatgaccgagtaaaaaacatctatcaattacacaaatgaacaagaatgtgagttagaaaaatgtaataaaatatgaatttcgaatattttattaagggatgatttaattcctggatttcaaaaacctttaaaaacatcaaacaataaacttttataaaaaagtgacaaaata

SEQ ID NO: 120690 - DNA, 2898 bp, Homo sapiens
  Payload ID: 3640
  Gene Symbol: CCDC110
  Gene Name: coiled-coil domain containing 110
  Uniprot ID: Q8TBZ0
  ENST ID: ENST00000307588
  CDS Start-End: 77-2578
tggcgacaggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaatttagatgacatttgccattctatcaaacaaatgaaagaagagcttcaaaagtcacatgatggggaagtggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaaaaatgagaaaaacaataaagaaattcccatcactggcaaaaatattacagatttaaaattccattccagagttccaagatacacactgtccttcctcgaccaaacaaaacatgaaatgaaagacaaagaaagacaaccatttctagtaaaacaaggatcaataatatctgaaaatgagaaaacttccaaagttaattccgttactgagcagtgtgttgcaaaaattcagtacttacagaattacctaaaagaatctgtgcagatacagaaaaaagtaatggaactggagagtgaaaatctaaaccttaagtccaaaatgaaacctcttatctttaccacacaatctctcatacagaaagttgaaacatatgaaaagcaacttaagaatctggttgaagaaaagagtactattcagtctaagttaagtaaaacagaagaatacagcaaagagtgtcttaaagaatttaaaaaaataattagtaaatataatgttctgcaaggccaaaataaaactctagaggaaaaaaatatacaactttctttagagaagcaacaaatgatggaagcattagatcaactaaaaagtaaggaacacaaaactcaaagtgatatggccattgtaaataatgaaaataatcgaatgagtatagaaatggaagcaatgaaaaccaatattctgttgatacaagatgaaaaagaaatgttagagaaaaaaacacaccagcttctaaaagaaaaaagctcacttggaaatgaactaaaagaaagccagctagagataatccagctaaaagagaaagaaagattggcaaaaacggaacaagagacacttcttcaaataatagaaacagttaaagatgaaaaactcaaccttgaaacaacattacaagaatctactgctgccagacaaattatggaaagagaaattgagaatattcaaacctaccaatctactgccgaagagaattttctgcaagaaataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttacatttcaagaagagagaaattccattttgacaactatactcacgaagatacttctagtcctcagagtaggcctttggcttcggatttgaaaggttatttcaaagttaaagacagaactctcaagcatcattaggattcctcaagattgctaagaaactcccttcgagaaatagccaatgttaattgtactgctaactgaactatgcatatctaactcatctcaaatgactcataatgaggcgctatatatttgctttaaaaattatgcacagaatggtttggtgcagataacttaagctttctcagctgggaatttcagaagatgggggagaacttctacaagggagggcaggtacctgtacatggaaggagctgagatgtctaaagtcacccacatttgtcatttaaaaaagtatatataaataaaagatactattttgaagaagtataaaa

SEQ ID NO: 120691 - DNA, 2722 bp, Homo sapiens
  Payload ID: 3640
  Gene Symbol: CCDC110
  Gene Name: coiled-coil domain containing 110
  Uniprot ID: Q8TBZ0
  ENST ID: ENST00000393540
  CDS Start-End: 12-2402
gagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaatttagatgacatttgccattctatcaaacaaatgaaagaagagcttcaaaagtcacatgatggggaagtggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaaaaatgagaaaaacaataaagaaattcccatcactggcaaaaatattacagatttaaaattccattccagagttccaagatacacactgtccttcctcgaccaaacaaaacatgaaatgaaagacaaagaaagacaaccatttctagtaaaacaaggatcaataatatctgaaaatgagaaaacttccaaagttaattccgttactgagcagtgtgttgcaaaaattcagtacttacagaattacctaaaagaatctgtgcagatacagaaaaaagtaatggaactggagagtgaaaatctaaaccttaagtccaaaatgaaacctcttatctttaccacacaatctctcatacagaaagttgaaacatatgaaaagcaacttaagaatctggttgaagaaaagagtactattcagtctaagttaagtaaaacagaagaatacagcaaagagtgtcttaaagaatttaaaaaaataattagtaaatataatgttctgcaaggccaaaataaaactctagaggaaaaaaatatacaactttctttagagaagcaacaaatgatggaagcattagatcaactaaaaagtaaggaacacaaaactcaaagtgatatggccattgtaaataatgaaaataatcgaatgagtatagaaatggaagcaatgaaaaccaatattctgttgatacaagatgaaaaagaaatgttagagaaaaaaacacaccagcttctaaaagaaaaaagctcacttggaaatgaactaaaagaaagccagctagagataatccagctaaaagagaaagaaagattggcaaaaacggaacaagagacacttcttcaaataatagaaacagttaaagatgaaaaactcaaccttgaaacaacattacaagaatctactgctgccagacaaattatggaaagagaaattgagaatattcaaacctaccaatctactgccgaagagaattttctgcaagaaataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttacatttcaagaagagagaaattccattttgacaactatactcacgaagatacttctagtcctcagagtaggcctttggcttcggatttgaaaggttatttcaaagttaaagacagaactctcaagcatcattaggattcctcaagattgctaagaaactcccttcgagaaatagccaatgttaattgtactgctaactgaactatgcatatctaactcatctcaaatgactcataatgaggcgctatatatttgctttaaaaattatgcacagaatggtttggtgcagataacttaagctttctcagctgggaatttcagaagatgggggagaacttctacaagggagggcaggtacctgtacatggaaggagctgagatgtctaaagtcacccacatttgtcatttaaaaaagtatatataaataaaagatactattttgaagaagtataaaa

SEQ ID NO: 120692 - DNA, 788 bp, Homo sapiens
  Payload ID: 3640
  Gene Symbol: CCDC110
  Gene Name: coiled-coil domain containing 110
  ENST ID: ENST00000510481
  CDS Start-End: 70-270
aggatgccctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacaggtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaatttagatgacatttgccattctatcaaacaaatgaaagaagagcttcaaaagtcacatgatgggg

SEQ ID NO: 120693 - DNA, 467 bp, Homo sapiens
  Payload ID: 3640
  Gene Symbol: CCDC110
  Gene Name: coiled-coil domain containing 110
  ENST ID: ENST00000508538
  CDS Start-End: 1-375
gaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttacatttcaagaagagagaaattccattttgacaactatactcacgaagatacttctagtcctcagagtaggcctttggcttcggatttgaaaggtggaaacaatacacatgcctgccctggctccagaggaaacacaatctctagcttccaaggttgcaagcacacctgttctgtgctccagagacactctgtcttccaagactgctattcaaatattccttgttgaattctgtccaaagctttttctacatttattggaggttatttcaaagttaaagacagaactctcaagcatcattaggattcctcaagattgct

SEQ ID NO: 120694 - DNA, 789 bp, Homo sapiens
  Payload ID: 3640
  Gene Symbol: CCDC110
  Gene Name: coiled-coil domain containing 110
  ENST ID: ENST00000506876
  CDS Start-End: 17-789
gagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttggaaaaatggaccatcagagatgaaaataaggaaactccggtcctgaaaaccttaaaagatcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaattt

SEQ ID NO: 120695 - DNA, 470 bp, Homo sapiens
  Payload ID: 3640
  Gene Symbol: CCDC110
  Gene Name: coiled-coil domain containing 110
  ENST ID: ENST00000504020
  CDS Start-End: 20-169
agagagatgagccgcggcgatgagcccggaaaagcagcaccgggaagaggatgaagttgactccgttctcctttcagcgtccaagatcctaaattcttcggagggggtgaaggaaagtggctgcagtgacacagataaggaaacgggcacagagaggttaactccctaaggtcacacaggcagcgaggaatggagcgggcattcagcagggcggctccggactgcctgtcttcaccaccacgctacgctccgttgcttctctgaatgctaaaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaa

SEQ ID NO: 120696 - DNA, 2592 bp, Homo sapiens
  Payload ID: 3640
  Gene Symbol: CCDC110
  Gene Name: coiled-coil domain containing 110
  ENST ID: ENST00000510617
  CDS Start-End: 62-2572
ctgcgcggggcggcggagcgggtgcgtgcggcggcggttgcgagagagatgagccgcggcgatgagcccggaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctggataaatccaaaattactgtgccttttctcaagcatggattttgtgaaaatttagatgacatttgccattctatcaaacaaatgaaagaagagcttcaaaagtcacatgatggggaagtggcacttacaaatgaacttcagactttacaaactgatccagatgttcacaggaatggtaaatatgacatgtcccctattcaccaggataaaatgaactttattaaggaagaaaacttggacggtaacttaaatgaagatataaaatcaaagagaatttcagaattagaggcattagtgaagaaattactccccttcagggaaactgtgtcaaaattccatgtgcatttttgtagaaaatgtaaaaagttatctaagagtgaaatgcacaggggaaagaaaaatgagaaaaacaataaagaaattcccatcactggcaaaaatattacagatttaaaattccattccagagttccaagatacacactgtccttcctcgaccaaacaaaacatgaaatgaaagacaaagaaagacaaccatttctagtaaaacaaggatcaataatatctgaaaatgagaaaacttccaaagttaattccgttactgagcagtgtgttgcaaaaattcagtacttacagaattacctaaaagaatctgtgcagatacagaaaaaagtaatggaactggagagtgaaaatctaaaccttaagtccaaaatgaaacctcttatctttaccacacaatctctcatacagaaagttgaaacatatgaaaagcaacttaagaatctggttgaagaaaagagtactattcagtctaagttaagtaaaacagaagaatacagcaaagagtgtcttaaagaatttaaaaaaataattagtaaatataatgttctgcaaggccaaaataaaactctagaggaaaaaaatatacaactttctttagagaagcaacaaatgatggaagcattagatcaactaaaaagtaaggaacacaaaactcaaagtgatatggccattgtaaataatgaaaataatcgaatgagtatagaaatggaagcaatgaaaaccaatattctgttgatacaagatgaaaaagaaatgttagagaaaaaaacacaccagcttctaaaagaaaaaagctcacttggaaatgaactaaaagaaagccagctagagataatccagctaaaagagaaagaaagattggcaaaaacggaacaagagacacttcttcaaataatagaaacagttaaagatgaaaaactcaaccttgaaacaacattacaagaatctactgctgccagacaaattatggaaagagaaattgagaatattcaaacctaccaatctactgccgaagagaattttctgcaagaaataaaaaatgcaaaatcagaagcaagtatttataagaatagcttgtcagaaattggcaaggaatgtgaaatgttatcaaaaatggtaatggaaaccaaaacagataatcagattctaaaagaagaactaaagaaacatagtcaagaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttacatttcaagaagagagaaattccattttgacaactatactcacgaagatacttctagtcctcagagtaggcctttggcttcggatttgaaaggaattccaagtaaactgtatcatttgcttccatccaagatatataaataaactgctaaaatcaatgtttc

SEQ ID NO: 120697 - DNA, 544 bp, Homo sapiens
  Payload ID: 3640
  Gene Symbol: CCDC110
  Gene Name: coiled-coil domain containing 110
  ENST ID: ENST00000506962
  CDS Start-End: 200-544
cagccccgccacgccacgacccgcgacagaacagccccggacggttctgttacagaaaagcagcaccgggaagaggatgaagttgactccgttctcctttcagcgtccaagatcctaaattcttcggagggggtgaaggaaagtggctgcagtgacacaggtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattata

SEQ ID NO: 120698 - DNA, 705 bp, Homo sapiens
  Payload ID: 3640
  Gene Symbol: CCDC110
  Gene Name: coiled-coil domain containing 110
  ENST ID: ENST00000507501
  CDS Start-End: 255-705
agccccgccacgccacgacccgcgacagaacagccccggacggttctgttacagaaaagcagcaccgggaagaggatgaagttgactccgttctcctttcagcgtccaagatcctaaattcttcggagggggtgaaggaaagtggctgcagtgacacagaatatggctgcatagcagaatcagaaaatcaaatccaaccacaatcagcattgaaagtccttcagcagcagttggaatcatttcaggctttgcgaatgcagactttgcagaatgtcagcatggtacagtcggaaatcagtgaaatattgaacaaaagtattattgaagtagaaaacccacaatttagctcagaaaaaaatctggtgtttggcacgcgcattgaaaaggatttgcctacagagaatcaagaagaaaacctttctatggagaaaagtcatcattttgaggattccaagacacttcattcagtggaagaaaaattaagtggtgatagtgtgaacagtctccctcaaagtgtaaatgttccatcccagatacattccgaggacacattaactctgagaacttcaacagacaatttatcttcaaacataattatacacccttcagaaaattctgacatcttgaagaattataataacttttatcgttttctacctactgcacctccaaatgtgatgtctcaagctgatacagtaattctgg

SEQ ID NO: 120699 - DNA, 2566 bp, Homo sapiens
  Payload ID: 3641
  Gene Symbol: CCDC112
  Gene Name: coiled-coil domain containing 112
  Uniprot ID: Q8NEF3
  ENST ID: ENST00000379611
  CDS Start-End: 289-1878
ggcaccttgcccctccctcgccccgcccctccccgcctgaatcccggcccccgcctcgcatttcggccccgccctgcaccccagtcccgcccctcccgcacccccgcacccctgcacccccgcatctcagccccgccctgcatcccgaccccgccctacatctcggccccgccctgcatcccggccaagcccgcagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaagcatgctttgttttatatagagaatatttattttaaaaatatgtctctcatataccctattaattgtattattgatataatctttttggtttccttcagcaattccaaattttccttcagcctttctggatttcacagatttataaaatctttgtgtctttcacatc

SEQ ID NO: 120700 - DNA, 2069 bp, Homo sapiens
  Payload ID: 3641
  Gene Symbol: CCDC112
  Gene Name: coiled-coil domain containing 112
  Uniprot ID: Q8NEF3
  ENST ID: ENST00000395557
  CDS Start-End: 492-1832
gtttaacagcttttgcagagccgcctccatgtggtttcggagtcgaggaagacctgggtgggaacccggctctgccgcttcctagccgcgtgataagaacatatgctgtcggcgactcactttcttctctaaaaattgggaatagtaacatgcacctcccgagctttggactaacgttatgtctggggagcccctggcacagtgcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataa

SEQ ID NO: 120701 - DNA, 2279 bp, Homo sapiens
  Payload ID: 3641
  Gene Symbol: CCDC112
  Gene Name: coiled-coil domain containing 112
  Uniprot ID: Q8NEF3
  ENST ID: ENST00000512261
  CDS Start-End: 418-1758
gcttgattggagggggactctgtgctcagtaattggtggcagctctgttactgtaccggcgctgggaacacaaggagaaagacaatatgggatggtcggaggcagaggtgtttccagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaggtgcaaactaacaatgagaactccttactgttagactaaattcaaggggcaaagatgtgctgaaagaagcctgaagtaaatgtagacaatagtcattaaatacccgaaatttcctgtctttgtagatgagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataaatattttgtatttgtttgaa

SEQ ID NO: 120702 - DNA, 2145 bp, Homo sapiens
  Payload ID: 3641
  Gene Symbol: CCDC112
  Gene Name: coiled-coil domain containing 112
  ENST ID: ENST00000506442
  CDS Start-End: 400-1644
tgcatcccgaccccgccctacatctcggccccgccctgcatcccggccaagcccgcagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaagaagaagaagagaaagagaaaaaacatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagttgaaaacaatgttagtagagatccctctaggctttacaaacccaccaaaggttgggaagaacgaaccaaaaagataggaccaacaggctctgggccacttctacatatcccacatagggctattccaacctggagacaaggaatacagagaagagtatgagataatcaaattgctactcagttgataagaatgttaacatactaagttataccagggagagagtgactaaccacattctttaaatatcaatagcttagtcagattgattattgtgctatattgtgaattgagaggtattaagtttcatgaggctttgtcattagtattcctgcttctaccaagaaggtatttaatatatgtgttggcctattattgatgtaaaagttatttaaataagttaatgttagaaacattattcaatttaaatactgaaaacatttcaaagagattttgtttttgttatagcatagcaaagtaaattggaacaatcatacaatgacattttttaaaccaaaattttgtaacttttataacttggagttaagttagcttgagtaacaaaaaggtaaagtggtttttgtttagagttacgaaatgttagtactttttctatgtttaacaaattggcagtttgtcagttatgacatttttgtgtaataa

SEQ ID NO: 120703 - DNA, 5272 bp, Homo sapiens
  Payload ID: 3642
  Gene Symbol: CCDC113
  Gene Name: coiled-coil domain containing 113
  Uniprot ID: Q9H0I3
  ENST ID: ENST00000219299
  CDS Start-End: 80-1213
gcagccggagtgacgcgtggccgccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgcgtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgacttttaaaaaaaa

SEQ ID NO: 120704 - DNA, 5110 bp, Homo sapiens
  Payload ID: 3642
  Gene Symbol: CCDC113
  Gene Name: coiled-coil domain containing 113
  Uniprot ID: Q9H0I3
  ENST ID: ENST00000443128
  CDS Start-End: 80-1051
gcagccggagtgacgcgtggccgccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgcgtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgacttttaaaaaaaa

SEQ ID NO: 120705 - DNA, 557 bp, Homo sapiens
  Payload ID: 3642
  Gene Symbol: CCDC113
  Gene Name: coiled-coil domain containing 113
  ENST ID: ENST00000561517
  CDS Start-End: 64-240
gtggccgccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaa

SEQ ID NO: 120706 - DNA, 556 bp, Homo sapiens
  Payload ID: 3642
  Gene Symbol: CCDC113
  Gene Name: coiled-coil domain containing 113
  ENST ID: ENST00000569374
  CDS Start-End: 365-556
aacatgatgttgaatgaacgaagccagtcacaaaggagaatgcactgcatgattctagaaaaataaatcttacaactggtgtccttataagaagaggaggggacacacaaagccacagggaagaagtccatgcaaagatggaggcagagattggagtgatgtagctacaatctaaggaatgacaagattgccaggagccaccagaagctgggaagaggcaagaaaagattcctcctagagccttcagagggagagtggctgtgcagacaccttgcctccagacttctggcctccggaactgtgagatgatacatttctgttgttcttatgctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcg

SEQ ID NO: 120707 - DNA, 891 bp, Homo sapiens
  Payload ID: 3642
  Gene Symbol: CCDC113
  Gene Name: coiled-coil domain containing 113
  ENST ID: ENST00000616795
  CDS Start-End: 39-611
gggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaaagcaagcttcacaaggcaatggaaatatacctcaatctggacaaggagatcttgctgagaaaagagctact

SEQ ID NO: 120708 - DNA, 3215 bp, Homo sapiens
  Payload ID: 3643
  Gene Symbol: CCDC114
  Gene Name: coiled-coil domain containing 114
  Uniprot ID: Q96M63
  ENST ID: ENST00000315396
  CDS Start-End: 684-2696
cccagaactccctgtaggaattgccaaggggagaaggaaggaagggtgtttctacagagatgacagaatgtggctagagtaggctttctcaaccttggtactgttgactcttggggtgggataattctttgttgtgggggcagtcctgtgtgtcgtaggatgccaagcagtgtccatggcttctactcactggataccagtagccccctcccttctccacaagtcatgacaatgacaaatgtctctaggctgagcatgctggctcatgcctgtaatcccagcactttgggaagctgaggaaggaggatcacttgagcccaggagttcaagaccagcctgagcaacacagtgagacctcatctctacaaaaataaaataaaattagccaggtgtgatggcgtgcacccataatcccagctactcgggaggctgaggtgggcggatcacttgagcctgcgaggtggaggctgcagtgagctgagattgtgccactgcgctagagcctgggggacagagcgagaccctgtctagaaaaaaataagtctccagacattgccaaatgtttttggaaggcagaatcacccgctgattgaaaactactgggcctttggagatggggagcatacgggcaagactggagagtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgctgcgggagcgcgcggagaaagaggaggcccagagcgagatggaggcgcaggtcctgcagcggcagatcttgcacctggagcagctgcaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagctgg

SEQ ID NO: 120709 - DNA, 1646 bp, Homo sapiens
  Payload ID: 3644
  Gene Symbol: CCDC115
  Gene Name: coiled-coil domain containing 115
  Uniprot ID: Q96NT0
  ENST ID: ENST00000259229
  CDS Start-End: 225-767
acttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactacccaa

SEQ ID NO: 120710 - DNA, 1247 bp, Homo sapiens
  Payload ID: 3644
  Gene Symbol: CCDC115
  Gene Name: coiled-coil domain containing 115
  ENST ID: ENST00000409127
  CDS Start-End: 96-623
gttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccac

SEQ ID NO: 120711 - DNA, 1847 bp, Homo sapiens
  Payload ID: 3644
  Gene Symbol: CCDC115
  Gene Name: coiled-coil domain containing 115
  ENST ID: ENST00000442217
  CDS Start-End: 225-806
acttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggtgtcctggaggccaagaagagaaagtgtttcctggagcgagtgatccaatgtgtggtcagccctgctgctgaacaggaggccgaagacgagagctgcccggaggactgggcagcagctgttccagcagagacatcagcaaaagccatctagaggtggatccagagtgtggactaacagagaaaagaagtggagggagagcaggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactaccc

SEQ ID NO: 120712 - DNA, 2260 bp, Homo sapiens
  Payload ID: 3645
  Gene Symbol: CCDC116
  Gene Name: coiled-coil domain containing 116
  Uniprot ID: Q8IYX3
  ENST ID: ENST00000292779
  CDS Start-End: 162-2003
aagcaagtggaggccgccagccgacttcctcgcactgtgcagctgctccagtgagggcgcagactgtactggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctggttctcagggctgctgggctcaagctctggcgtgcctgaagcatcagagccgaggcctggagaacaggagccaatcttccgcaagcgagagttcaataaggagatcaagtcattactgagccagctggagtccctcgacctgcctggctactgtccgctccgtgagccccatcgcacgctgaacttcctggctgaccaccgcctcttccctgccctgcaaagcgtggtcagccaggctgtggataagctccgtggcgcccactgccgcgacggccgtcctctgttccccaccagcttggagcccacctcagatctgccgcctctgggctctgagccagctaaacccaccaatggcgggcagccctatgcttccccccgccccacagtctccagccccaagatgcttcagagaaaacgcaaggacagaggaggctccccctccatgtctagtgcccaggtggccaccagattcaaactcaagagcccctgcagcagcagcaggttcacgaagaagaagccgctgccctccatctcgtcgaagtccagcatgtctcacttctccaaccgcctttatgaggagctcgccgacttcctgacccagcaggcagcctccttggtcatccgcaagtacgagttcgaaaaggacctcagtaagcagctgggcttcttctccttccccatcacccacgtgctcagggacctttccctgggcttaaagaaggtaaaaggctcccgcatccacctgtcctcggagacccaccggagctgcctgctgcgtaaactggaggagtccaaaagggcccggcaggcctcccggctcagcacctcccactgcagcacagagacaccctctgtgcagcaggaaccagccacccacactgcccaggaccaggccacagagccctgccgctccctctacaccaacttgccagccagccggcagctcagccctttggagcccaagctctacatgtctgcctgcaccggcatgggttccagtccccccaagtccaaggacatggacaatgagggccgtgataaagccgagattgaagatgaagatgaggatgagttcaaggatgaagaccaggatgaggacaaggatgaggatggagtctagagcctcccagagcctggagaggaggcctcggtcagccactccgtggacgtgggccacggtgacccaccatgaagtccccactagccactcgattccctgctctgtcagagttgctgcacatcacaccagcccctgccaagagcaggagtcaccacaggctgaatgcccacgaggagctctgctgagactctcaagggagccagtgaaagaaatagaaataaagcctgtgttgctgggacacaggtttgctgtcctga

SEQ ID NO: 120713 - DNA, 572 bp, Homo sapiens
  Payload ID: 3645
  Gene Symbol: CCDC116
  Gene Name: coiled-coil domain containing 116
  ENST ID: ENST00000425975
  CDS Start-End: 115-572
ggtatgcaaataagcaagtggaggccgccagccgacttcctcgcactgtgcagctgctccagtgagggcgcagactgtactggcctgtgcggagcaaggcggtgtttctgacgcatgggggccatggagcagaggaagggctggatgcatgaaggaggcggggtgcggggagcgagggacccgcagactccagggccacagatgcgtggacctattggagaccctcaggttgtctccccaccccacgcagagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctgga

SEQ ID NO: 120714 - DNA, 1913 bp, Homo sapiens
  Payload ID: 3645
  Gene Symbol: CCDC116
  Gene Name: coiled-coil domain containing 116
  Uniprot ID: Q8IYX3
  ENST ID: ENST00000607942
  CDS Start-End: 175-1755
gtggtatgcaaataagcaagtggaggccgccagccgacttcctcgcactgtgcagctgctccagtgagggcgcagactgtactggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctggttctcagggctgctgggctcaagctctggcgtgcctgaagcatcagagccgaggcctggagaacaggagccaatcttccgcaagcgagagttcaataaggagatcaagtcattactgagccagctggagtccctcgacctgcctggctactgtccgctccgtgagccccatcgcacgctgaacttcctggctgaccaccgcctcttccctgccctgcaaagcgtggtcagccaggctgtggataagctccgtggcgcccactgccgcgacggccgtcctctgttccccaccagcttggagcccacctcagatctgccgcctctgggctctgagccagctaaacccaccaatggcgggcagccctatgcttccccccgccccacagtctccagccccaagatgcttcagagaaaacgcaaggacagaggaggctccccctccatgtctagtgcccaggtggccaccagattcaaactcaaggtgacacccacggagaagcccaatgtccccagcccctcactccactccagggaggaggcacctgactcagatcccaaattacaaaacccacctgtttccctgagctccagccagagggcccagccctggcagggcctgcacctcaccctgcccacgccagggattgtggtggaggtggcctgcagccagggccacctcaggggccctgtcacacctccactttcctccccctacccccgctcttcctgctaccttctccctgagctctctccagttgcctcttcatctcccgcctcactgtgtccagaggtgacctcctcaaaagtaggaccgggcatgagtttgcaggagaagggctccttgacccaccactcctagcagccactgtcactaacaggtgctcaaggtcaaggtctcttgccctgcactgtggaaacctcctgggcaggggtcaagctgatgggggcccatgaatcctggcctagctattaccaggtgttgtcacagataaataaaggctattttttatgctgggt

SEQ ID NO: 120715 - DNA, 3985 bp, Homo sapiens
  Payload ID: 3646
  Gene Symbol: CCDC117
  Gene Name: coiled-coil domain containing 117
  Uniprot ID: Q8IWD4
  ENST ID: ENST00000249064
  CDS Start-End: 177-1016
aacaaatcccggcatgcccccgagcggcctgaggtggagggttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttgga

SEQ ID NO: 120716 - DNA, 3766 bp, Homo sapiens
  Payload ID: 3646
  Gene Symbol: CCDC117
  Gene Name: coiled-coil domain containing 117
  Uniprot ID: Q8IWD4
  ENST ID: ENST00000421503
  CDS Start-End: 177-791
aacaaatcccggcatgcccccgagcggcctgaggtggagggttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgagataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttggacttttg

SEQ ID NO: 120717 - DNA, 3937 bp, Homo sapiens
  Payload ID: 3646
  Gene Symbol: CCDC117
  Gene Name: coiled-coil domain containing 117
  Uniprot ID: Q8IWD4
  ENST ID: ENST00000448492
  CDS Start-End: 177-962
aacaaatcccggcatgcccccgagcggcctgaggtggagggttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgttgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttggacttttg

SEQ ID NO: 120718 - DNA, 463 bp, Homo sapiens
  Payload ID: 3646
  Gene Symbol: CCDC117
  Gene Name: coiled-coil domain containing 117
  ENST ID: ENST00000444523
  CDS Start-End: 123-463
gacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgttgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaaga

SEQ ID NO: 120719 - DNA, 1026 bp, Homo sapiens
  Payload ID: 3646
  Gene Symbol: CCDC117
  Gene Name: coiled-coil domain containing 117
  ENST ID: ENST00000453543
  CDS Start-End: 147-335
gaggtggagggttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacggtgaggagcccgtcgggcgcagggcgcagggcgggcgggcgggcgggcaggctgggcgcccctcgcggcgggcgcgggcaggggcgcgggctccgcgccggggctttttgactccctccccacggccctccgcgggagcttcgcagcccagtttacagatgaagaaactgatccccggagacgttaacttgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaact

SEQ ID NO: 120720 - DNA, 568 bp, Homo sapiens
  Payload ID: 3646
  Gene Symbol: CCDC117
  Gene Name: coiled-coil domain containing 117
  ENST ID: ENST00000432510
  CDS Start-End: 358-568
acatagcccaggagtccggtccgaacctcagctcgactgcggcccggagaagtgagactttcccagttggaacctgggcgactcggtctgggtgccccctcggcgcggccgctgttagtgacaactttcagtgtctcatctgcaaatgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagcc

SEQ ID NO: 120721 - DNA, 1017 bp, Homo sapiens
  Payload ID: 3647
  Gene Symbol: CCDC12
  Gene Name: coiled-coil domain containing 12
  ENST ID: ENST00000292314
  CDS Start-End: 152-691
tggccccaggctgcccactgtctgctcaggcttccaaagctacaacctgccagcctatgctccatacctgccctgcgaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggc

SEQ ID NO: 120722 - DNA, 412 bp, Homo sapiens
  Payload ID: 3647
  Gene Symbol: CCDC12
  Gene Name: coiled-coil domain containing 12
  ENST ID: ENST00000446836
  CDS Start-End: 146-412
cctgccagcctatgctccatacctgccctgcgaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcag

SEQ ID NO: 120723 - DNA, 1097 bp, Homo sapiens
  Payload ID: 3647
  Gene Symbol: CCDC12
  Gene Name: coiled-coil domain containing 12
  Uniprot ID: Q8WUD4
  ENST ID: ENST00000425441
  CDS Start-End: 266-766
ggcttccaaagctacaacctgccagcctatgctccatacctgccctgcgaggtctgaattccacttgctgctctttcactgatcagcgttggataaatcgagccttagcttttttttttttcttttttttttttgctggctccccacccactaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcagaaa

SEQ ID NO: 120724 - DNA, 380 bp, Homo sapiens
  Payload ID: 3647
  Gene Symbol: CCDC12
  Gene Name: coiled-coil domain containing 12
  ENST ID: ENST00000605875
  CDS Start-End: 137-380
ggccgggcggcccgggagggtgccccgctgccctgccccaccagtgccattggaagggccagcctgagcctccgggacgagggtcggggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcag

SEQ ID NO: 120725 - DNA, 2381 bp, Homo sapiens
  Payload ID: 3648
  Gene Symbol: CCDC120
  Gene Name: coiled-coil domain containing 120
  Uniprot ID: Q96HB5
  ENST ID: ENST00000536628
  CDS Start-End: 283-2139
actaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaa

SEQ ID NO: 120726 - DNA, 2752 bp, Homo sapiens
  Payload ID: 3648
  Gene Symbol: CCDC120
  Gene Name: coiled-coil domain containing 120
  Uniprot ID: Q96HB5
  ENST ID: ENST00000597275
  CDS Start-End: 508-2400
accctctaggctaggctgagcggcggaggtggccgtgccgctggaagcggacagacccgagttagaggtgggggcgggggtccatcgcccgcggccgggccggcgctcccctcctaccctccccgcgacccccgtctggcccccacggctaacggtagcgcagccgaacacggcccacgggcagggcgccgaagaggagcaggcgcgcgcccggggacgagcagggcgcagtgagggaggggcgcgtccactgccccggccggccgaccgacaccgaccccgcctactgcggcgcggggacccttggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttc

SEQ ID NO: 120727 - DNA, 2379 bp, Homo sapiens
  Payload ID: 3648
  Gene Symbol: CCDC120
  Gene Name: coiled-coil domain containing 120
  Uniprot ID: Q96HB5
  ENST ID: ENST00000603986
  CDS Start-End: 178-2268
gctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaaggactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcg

SEQ ID NO: 120728 - DNA, 2478 bp, Homo sapiens
  Payload ID: 3648
  Gene Symbol: CCDC120
  Gene Name: coiled-coil domain containing 120
  ENST ID: ENST00000603906
  CDS Start-End: 123-314
agccggagccagggcctggtcgagacaactatttttgaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgactta

SEQ ID NO: 120729 - DNA, 2415 bp, Homo sapiens
  Payload ID: 3648
  Gene Symbol: CCDC120
  Gene Name: coiled-coil domain containing 120
  Uniprot ID: Q96HB5
  ENST ID: ENST00000496529
  CDS Start-End: 296-2188
attacctagtgggaggtggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagcca

SEQ ID NO: 120730 - DNA, 3857 bp, Homo sapiens
  Payload ID: 3648
  Gene Symbol: CCDC120
  Gene Name: coiled-coil domain containing 120
  Uniprot ID: Q96HB5
  ENST ID: ENST00000606812
  CDS Start-End: 220-2112
ggccaaggcatctgccactgctgctgactgccactaccagccggagccagggcctggtcgagacaactatttttgaggcaagactcgtggctgtgacccatgggcctctgaggaggcgttgtaagtccgcccagctccccacttgctgtgctctcactcaatgcgaagggaaccaagactttgtccagccatcagccacggcctctcgacagcaccaagatggaagtcaaaggtcagctgatcagctctcctaccttcaatgccccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggagctgactggccagctgccccctgagtgcccactagagcctggtgaacggccccagttggtccgccggcggccccccacagcccgcgcctaccctccaccgcaccccaaccaagcacaccactccttgtgccctgctgaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaagaggacgtagttctgcactcagagagcagctccctctcagagtctggggccagccatgacaacgaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccagccccacacgctcgctgcccaggagtgcctccagttttgaggggcgaagtgtgcctgccacccctgtcctcacccggggcgctggcccccagctctgcaaacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccc

SEQ ID NO: 120731 - DNA, 2342 bp, Homo sapiens
  Payload ID: 3649
  Gene Symbol: CCDC121
  Gene Name: coiled-coil domain containing 121
  Uniprot ID: Q6ZUS5
  ENST ID: ENST00000324364
  CDS Start-End: 182-1018
agagaaacttccgcaatgttctgggctgcgaacgaaaaccaccacagcgtcagaaaggagcgggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccaggcgaggcagagactgcaaggaagtcataatcagtgcctaaatagacaggatgttccaaagaccacacccagtcttccccaaggcaccaaatcaaggattaatccaaagtaacttctaaaataacactgattaaataagaactggagcaagtactcttaagtgctacattaacctggttagaaaggctgttggattccagattgctattgtaaaatctccatcatgatgtgttggagtgaaggattagatggttttatccaacagtcctactagatatttggtaaccagcttcccttaactagctttttctttaaatactcgttaataagctattccacaaacctccagttaacctaacacatgaccctaacctagccatttaccatacatcaaactagctaaaggaaaccaacctaaggaagtgaaaacagttgtgatttatttcatctagctaaattgtatttctttatagagaaagtacctttaaggatagcattccaaatagactttgaatagcgttctgccagtttatcctcattccttttgaccaacttagcagacaaaagcagtttttacaagctctttgtgagtttgtgccagtgaccaggtagctccttctagttttctcatgagtgaaaaagcattctgataacagcaagtccagtaagtgctaggcagagtgacctttcatctgatgctaagcccctacaagtttgagaaggtaagaaaagatgaaggagacatatattaggtcagctcttacttttgaaaatgttttatttgaagaaacacctgtagcattgaggtgactgaatgcctccacttatttcaggaaaacgtatccaaaaaaagttgaaatatttggacaactttttttttaagtgccatcgatttccctagcagcattctaaaagatagcaagtaaaatgatgtttgttatcctaaatgctttagttttaggtcatttattaattttcttacaggtgcactttctagtacatgaagtatcctttgtaattaatgtgtgccatatgtttattcccatttagtataactataaattatattttaaattatatatttttaggatagttatattttttttgggttctacgacattgaagttggactagtgatttatttgaatgctgaatcctagtataggggaatataatcttatattttaacaggggtcctctatgggaaaataggatgaactttgtttcccagaaattgttaagtgatgaaaaacttcaaaataattttcctgcattttctgctttatttacatgtaaagtgaattccctgaaaattggatttaaaaagcattctccttcaatgtgcctttaccttgtagctttaacaacttttctgttaaatatgtagttttttattaaacaatgttattaaataaaaacatttatccactgatttt

SEQ ID NO: 120732 - DNA, 1472 bp, Homo sapiens
  Payload ID: 3649
  Gene Symbol: CCDC121
  Gene Name: coiled-coil domain containing 121
  Uniprot ID: Q6ZUS5
  ENST ID: ENST00000394775
  CDS Start-End: 116-1438
ggcgaggaagtgggggcgctgagcaagcgagaggaaggctgaagggagctaggaaaagggcgctgatctctgcagcctgggagggcttttgtctcccggaggaaggccagaagagatggggtcccgagggcagggctcacacagcaagaaaacgaggagcatgcctgtcattttgagcccacagagaacggggagcggagccactggaggaccggctgctcgggcttattcggtagccgaggcggttaaacagttcagggctggaccagccgggactggagcagggtgcagtctccagggttgctgggcagcaccgagaccctttgagcaccgaacgaataaactacgggagctttccacacttgcacattgttcccgcgagttgcagacgcaggttcctgatgctagcgctcattccttggcagtcaccctcagtgaactacacagttgccgtgaccttcaggatgaatgcttggattccaggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaaaagaagagagcttaatatgaaggcccaggccttgaagttggcagcaaagcggtttatttttgaatactcctgtggcatcaacagagagaaccagcagttcaagaaggaattactgcagctaattgagcaagcccagaaactaacggctactcaaagccacttagaaaacaggaagcagcagctgcagcaggaacagtggtatctggagtccttaatccaggcgaggcagagactgcaaggaagtcataatcagtgcctaaatagacaggatgttccaaagaccacacccagtcttccccaaggcaccaaatcaaggattaatccaaagtaacttctaaaataacactgattaaataagaactgga

SEQ ID NO: 120733 - DNA, 560 bp, Homo sapiens
  Payload ID: 3649
  Gene Symbol: CCDC121
  Gene Name: coiled-coil domain containing 121
  ENST ID: ENST00000522876
  CDS Start-End: 129-560
aactagtgacagtggcgaggaagtgggggcgctgagcaagcgagaggaaggctgaagggagctaggaaaagggcgctgatctctgcagcctgggagggcttttgtctcccggaggaaggccagaagagatggggtcccgagggcagggctcacacagcaagaaaacgaggagcatgcctgtcattttgagcccacagagaacggggagcggagccactggaggaccggctgctcgggcttattcggtagccgaggcggttaaacagttcagggctggaccagccgggactggagcagggtgcagtctccagggttgctgggcagcaccgagaccctttgagcaccgaacgaataaactacgggagctttccacacttgcacattgttcccgcgagttgcagacgcaggttcctgatgctagcgctcattccttggcagtcaccctcagtgaactacacagttgccgtgaccttcaggatgaatgcttggattccaggtgcaagtttgctgagggccccagaaggctccttccaccgtatcatagtctaataaataatttt

SEQ ID NO: 120734 - DNA, 2009 bp, Homo sapiens
  Payload ID: 3650
  Gene Symbol: CCDC122
  Gene Name: coiled-coil domain containing 122
  Uniprot ID: Q5T0U0
  ENST ID: ENST00000444614
  CDS Start-End: 260-1081
tcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgacaacaaaaattactggacagaacattaagaaaatcttttggattcttaataacaagcatccactattagagacctgtcttaatgacagatgtcttcggttgttgttttttttaaatcagtcatcgatttgttaaaatgccttctaaccctacacttgatagcagtagacagacaataggaatgtctacgggaaaataatgcaagagtctctgtgactatttggagtgtgtaaaatgtattatactcatgaatacctgtttatgttgcattcactaccctatgaagtaaaaatttagaagggaaaaaacactcgaattttcactgatttaaattgttaagatttttaaaatgtttgtctgtttcgaactttttttttttttttttttttgagacggagtctcgctctgtcgcccaggccggactgcggactgcagtggcgcagtctcggctcactgcaagctccgcttcctgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtttcgaactttttattggaacttgtttttttacagctgccttcacagtagcccataaatattgatatttataataatgtttttgtatgttcaatgcttcaaatattttactccattttctcttttatccagaaggtaacaatcatttttctttgttataaaataacatattttgagtgatacgatgaataaaatattttgttcactttctataaa

SEQ ID NO: 120735 - DNA, 651 bp, Homo sapiens
  Payload ID: 3650
  Gene Symbol: CCDC122
  Gene Name: coiled-coil domain containing 122
  ENST ID: ENST00000614023
  CDS Start-End: 1-69
aaattaagaaaagaaatagaggtaagtcttaattatctagatttcaatgttttatgggaccatttttaaaacttaacactatattcatatttccatagtttactctcaatactcaaaacagttgaagaacaagaaagaactataaaatttagtaaatacaaatcattaatagataactagagataaccccctcattcaaagatgttcaaatatgtgaatgtgttcaaacaatgcaagcattcactcctatttaaatctgggcgagggttcttccaggtttttctcattccactaagaacatgatacccaattaatggctagaaagcagctatgtagtcaaagaggatgcccattcttagatatcaaagactcctcaaaatagaataaaacacaatggaaagcatcgtctttccaaacctctctgacttcatattcgcaattatcaagagtcaagttaaaaaaacaaactgaaaatatgcaaaattgaaagtcagagtaaattcataatgtgttgtggtgctgcctgtggacttctattgtcattattgtttggatgaatggtgaacagaaatgtaaaataatatgctattaagggcaaataatttttgcctgaatacattaatttggaaaataaaaatatgcatgtttcaa

SEQ ID NO: 120736 - DNA, 938 bp, Homo sapiens
  Payload ID: 3651
  Gene Symbol: CCDC124
  Gene Name: coiled-coil domain containing 124
  Uniprot ID: Q96CT7
  ENST ID: ENST00000445755
  CDS Start-End: 45-716
gaggcgcgaccgggccggcgctggggtaagaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcc

SEQ ID NO: 120737 - DNA, 1055 bp, Homo sapiens
  Payload ID: 3651
  Gene Symbol: CCDC124
  Gene Name: coiled-coil domain containing 124
  Uniprot ID: Q96CT7
  ENST ID: ENST00000597436
  CDS Start-End: 108-779
gagacggactcttgctatgttgcccaggctggtcttgaactcctggcctcaagcaatcctcctgcctcagcctcccaaagcacggggattacaaaccctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggcacttgaa

SEQ ID NO: 120738 - DNA, 580 bp, Homo sapiens
  Payload ID: 3651
  Gene Symbol: CCDC124
  Gene Name: coiled-coil domain containing 124
  ENST ID: ENST00000596123
  CDS Start-End: 171-580
cttttacaaggagagcgctaagtccaaagcccttgttttatacagagaaggccacagaggccccaagagggtcatggctgcccaagtgtgattctgggggtgctgagtgccgatgtcccctccggcccctgctcccccatccccatcctcttcccgcagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgct

SEQ ID NO: 120739 - DNA, 2006 bp, Homo sapiens
  Payload ID: 3652
  Gene Symbol: CCDC125
  Gene Name: coiled-coil domain containing 125
  ENST ID: ENST00000383374
  CDS Start-End: 86-1024
gcggcggcagcggcgcacgcgcacggagaggaggctacttgccagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgaggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaa

SEQ ID NO: 120740 - DNA, 4198 bp, Homo sapiens
  Payload ID: 3652
  Gene Symbol: CCDC125
  Gene Name: coiled-coil domain containing 125
  Uniprot ID: Q86Z20
  ENST ID: ENST00000396496
  CDS Start-End: 109-1644
tgagctggagtccgggctccggtccccgccacggaccttgagagggtacccggggtcagacctggcagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaaaaggagtattttgaaagttaggtgcagaacagacagtacacctgagagagagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgag

SEQ ID NO: 120741 - DNA, 3615 bp, Homo sapiens
  Payload ID: 3652
  Gene Symbol: CCDC125
  Gene Name: coiled-coil domain containing 125
  Uniprot ID: Q86Z20
  ENST ID: ENST00000396499
  CDS Start-End: 44-1579
cagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgac

SEQ ID NO: 120742 - DNA, 1735 bp, Homo sapiens
  Payload ID: 3652
  Gene Symbol: CCDC125
  Gene Name: coiled-coil domain containing 125
  Uniprot ID: Q86Z20
  ENST ID: ENST00000511257
  CDS Start-End: 323-1483
acgcgcacggagaggaggctacttgccagacagcccattttttcttatgataaagacggcatttggctcatgagcaaggtggcaagatcatcaagtgagtcagacgtgcagctctgggaaacagaagaggatgacatgacagaagggagaagaaagaaatgaagcgagttttcagtattccaagcataagagccagcaagatacattccctcaagtgtccagaatttccaattacagacgacaaagtagcactgattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagc

SEQ ID NO: 120743 - DNA, 1536 bp, Homo sapiens
  Payload ID: 3652
  Gene Symbol: CCDC125
  Gene Name: coiled-coil domain containing 125
  Uniprot ID: Q86Z20
  ENST ID: ENST00000620431
  CDS Start-End: 1-1536
atgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaa

SEQ ID NO: 120744 - DNA, 2006 bp, Homo sapiens
  Payload ID: 3652
  Gene Symbol: CCDC125
  Gene Name: coiled-coil domain containing 125
  ENST ID: ENST00000610685
  CDS Start-End: 86-1024
gcggcggcagcggcgcacgcgcacggagaggaggctacttgccagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgaggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcgcttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaa

SEQ ID NO: 120745 - DNA, 2630 bp, Homo sapiens
  Payload ID: 3652
  Gene Symbol: CCDC125
  Gene Name: coiled-coil domain containing 125
  Uniprot ID: Q86Z20
  ENST ID: ENST00000619386
  CDS Start-End: 1-1536
atgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcgcttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccatctctactaaaaatacaaaaaattagctaggcctagtggcgcatgcctgtaatcccagctacttgggaggctgaggtaggagaatcgcttgaacctgggaggcaggggttgtggtaagccgagactgtgtcattgcactccagcctgggcgacaagagcgaaactctgtctcaaaaaaaaaaacaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaact

SEQ ID NO: 120746 - DNA, 1735 bp, Homo sapiens
  Payload ID: 3652
  Gene Symbol: CCDC125
  Gene Name: coiled-coil domain containing 125
  Uniprot ID: Q86Z20
  ENST ID: ENST00000612469
  CDS Start-End: 323-1483
acgcgcacggagaggaggctacttgccagacagcccattttttcttatgataaagacggcatttggctcatgagcaaggtggcaagatcatcaagtgagtcagacgtgcagctctgggaaacagaagaggatgacatgacagaagggagaagaaagaaatgaagcgagttttcagtattccaagcataagagccagcaagatacattccctcaagtgtccagaatttccaattacagacgacaaagtagcactgattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcgcttaaatcaaatattttctacattttctttttcttcttttgagatggagtcttgctctgtcacccaggttggagtgcagtggtgtgatctcggttcactgcaacctccgcctcccggttcaagc

SEQ ID NO: 120747 - DNA, 2473 bp, Homo sapiens
  Payload ID: 3653
  Gene Symbol: CCDC126
  Gene Name: coiled-coil domain containing 126
  Uniprot ID: Q96EE4
  ENST ID: ENST00000307471
  CDS Start-End: 458-880
agggaggcggagcggaagccgagtgcgagggacgagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctaccta

SEQ ID NO: 120748 - DNA, 890 bp, Homo sapiens
  Payload ID: 3653
  Gene Symbol: CCDC126
  Gene Name: coiled-coil domain containing 126
  Uniprot ID: Q96EE4
  ENST ID: ENST00000410069
  CDS Start-End: 346-768
ggtgatcttggttacttaaaggctctaagcttgagttttctcatccatcaaaacacacacctgactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaa

SEQ ID NO: 120749 - DNA, 2324 bp, Homo sapiens
  Payload ID: 3653
  Gene Symbol: CCDC126
  Gene Name: coiled-coil domain containing 126
  Uniprot ID: Q96EE4
  ENST ID: ENST00000409765
  CDS Start-End: 310-732
caaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatgcattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacct

SEQ ID NO: 120750 - DNA, 847 bp, Homo sapiens
  Payload ID: 3653
  Gene Symbol: CCDC126
  Gene Name: coiled-coil domain containing 126
  ENST ID: ENST00000448353
  CDS Start-End: 516-847
gcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgactacttggaagatgaactgttctcatcagcaacatgctattatgtcatcttttaggactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatgg

SEQ ID NO: 120751 - DNA, 9342 bp, Homo sapiens
  Payload ID: 3654
  Gene Symbol: CCDC127
  Gene Name: coiled-coil domain containing 127
  Uniprot ID: Q96BQ5
  ENST ID: ENST00000296824
  CDS Start-End: 134-916
atcgcgcctgcgcaccatgccacgcccggagcgggtactgagtgggggcgccgcgcctgcgcaaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaagtaattttctgtctgtttcatcactccctaaatactttctcctcaaattatttttctctgtcaccagattacattaagaatttgtcagataatgtgtagaactgcataacaggtaataggaagtagtaatattatattatcaagggtttatattttaaagatctctctcactccataaaggggaaataccaagtgtttcttgtatccagttgttacttaatgtgtgtttgttgtatgcagttgttacctaatgtgtgtttgttgtatgcagttgttacctaatgtgtgtgtgttgtatgcagttgttacctaatgtgtgtgtgttgtatccagttgttacctaatgtgtgtttggaatttggcttgtgtctgtattcagcaagcagatacttattagcaatgatatatactcaaaatacttgccatttatgagtaataatgccactttttgtgtaattcttcactctttacaaaatatttttatatgtattatctcattgtttaccacagccaacaaggtagacaggcacttatcaccccatgtcacacatagctactgggaattgagcctgtatacctgttcactcatggaatcctcagtcgaatcctgtgaagtgagtattactattacgctttgcggaggtgccccaaggccagcccccaggtgcgtgacctgctgggagatctcacaggactcagcacagggttggactcagcacagagcagaatcagcaaagggagagggtgtgtgggtggcgctcagaggagccacgtgtggacaccccaggatccactccctggagtcatacaggacacacctaactattaagaataagctcactggagactcagcacctggggcttttgctaagggctggtcatgtggtaccccctgcctggcctgtgtgggaattccccacttgtccagaaggagggtgggtttggtgtggtctgtgccgtgagcacaagtactgtggtcacagagccacgcgtaggagttaatggtgctgggaagtctcccagaatccgagttcccagatgtcagtcaagggccagccttgcacacaggccctggtaggacacagccttgggcctgctgtgtgaattcgtcaccacgcacctcactttacggagatgtggaagagctaacctgcctgaggtcacgcaggtagtagtgttggagccagtctgagcccgggcaccttttctccagaaccgcgagtaacctgtgtgcagtgatttgatagtgtgtggccaggcaggagcgggagcaggttgtccatctgctttcaagggccatgttctcccctcctgcccgtctgtacgggagtaggagcaactgttaaaaatcctaagctcatagagcccacgtggcagtatgagagccactattcatggagtgcatgttccaccctgagctgtacacgctttacacgcatgcgttgtttgaaatccgtggaaccccttgagcgcggcggaggcgggctcagagccaacatgcgctgcctgcaacagacacgggccccctgccatgctctgctctcggcacccacgccctgctaagggtgctcagatgcttcacccaggcaggagtgcagtggtgtgatggctaagggtgctcagatgcttctcttcttcagtggctgctagcgtgcctctctgctctaccaccatcgctttatctgagaaaaagtcacttttattttcattttttattttttttgagagggaatctctgtcacccaggcaggagtgcagtggtgtgatctcagctcactacagcctccgcctcctgggttcaagcgattctcctgcctcagcctcctgggtagctgggattacaggcgtgcgctaccacacccagctaatttttgttttgttagtagagacggggtttcaccatgttggccaggctggtctcgaactgctgacctcaggtgatccaccgcccccacctcggcctcccacagcactgggattacaggtgtgggccacggcacccggcccctaaaaagtcattttttcggtaaatctggacaaaactcttcctgttgttgtttgtacttcctgatgcatcaagacccttgcctaaagagcggtgcaggctccattcctgcggcaatccggtctgctgggtgtccctgtgtgaaccactccacgtttgtctttaaatgaagaaaacacagtcagctgctttgtaggtgaatgattttcgaggcaaattgttaatcctcatcctgtttctaatgtccagtgtgctgtcagcctagcttccttctatagtgagatagatatgttcagagccttcaagctggtgtggacactgacccgctgacccggtcctgcagagttaggaagacgagcattttttttttgagacagtctcgttctgttgccaggcgggagtgcagtggcacaatctcgcctcactgcaagctctgcctcccgggttcgagtagtttgcctgcctcagcctcccgagtagctgggactacaggtgcctgccaccatgcctggctaatttttgtatgtttagtagagacagggtttcaccatgttggccaggatggcctcaaacttctgatctcaggtgatccacctgcctcagcctcccaaagtgctgggattaggggcgtgagccaccgtgcctggccggaagatgctctttccacagggttgatattagttcgtgtttgtgtggcgtggctgccttccatcagcaagtttgagtgttgatgtgaggccaccctcttttgaaatggattgtggtcggtttggaatagttacacggtgctgtgccatttggtaactccacacatgtaccgaaaggtgagcccacagtggaacgctcctcaaccaaagtggtttaaagttgcagaaaagggtaattgtgctggttggtgtgtgtgctgaatttgtagcgacatcagagtcaagcattatttgtcctgctgctttcttggaggtcacagtaactataaaaccgtgagccagcaaggcagagaggaccctttggggtaaggagtggagctctgggagatcctaggtttcggaagcaggtccagtttccttggggaggggagggctcgctgcagggcggaggaggggcagccactgtaatccttgtctggagtgaacattgtatatgaggttgcagtggcttaaaaaggaaggacttttgcggggaggggttgagattgtactttctaatttcgcttgcttcagacttgactttggaatgaagttcgaaggcatcacaattgacctggacattccaaaaacaaaactgaagaggcagcatttctcttccgtagtccagtcagctcatttggtagatgcgctttttcctcctttgcgcttattcatccataaggatatataatttgcatatatatttcatatgcgtgcatatgtgtgtgtatgtgtgaactggcaggtgttgatttcataaggacaaaattgttctgcaaaccttgcaccaattatggggtgtttcaacggaaaaacttcaccaaatgatctgtgtgttctttcaaagagaagttatgtctaattaaaatgtgtaacggactatttctgtgttggattgtttaaaaagtgattgcttcatagtgtactaagatcatctctttaagcagaagggagaaaacagctttctagttactttcacatattaggtttgctacataaaagcaagtctgaagactacacctgtgacattgcagagaccaaactgcagtgtgtgcagccatgagtggcagctgcttcctcctcgaggtgtcttgttccagcatgaggacagcccgtgcgatgttgggaggagccagggtgtttgggggggcagctgccctagacactggctggctgtgatggggggcagcctgctgtgtagacactggctggctgtgatggggggcagcctgctgtgtagacactggctggctgtgatgggggcagcctgctgtgtagacgctggctgtgatgggggcagcctgctgtgtagacgctggctggctgtgatgggggcagcctgctgtgtagacgctggctagctgtgatgggggcagcctgctgtgtagacgctggctggctgtgatgggggcagcctgctgtgtagaaagtgctgggcttgctccgtctgccttgacttgtgtgagtaactgcgctgggttttataggttgaggctgaaaaggctcctctttctatgctgggtttgacgaaacagttgctgtatttctctattaatttaggattctgtttgcaagcagcagagatggatttgtgctagcctagaaagttaaagagggatttaaggctgtctcgtgaaacttcaggtcaagaatggagaacacaggttagatgtcagagaagaaccagaaagacaaataagggactctcaggggcctcggagtacttgtcactctgtgtcatatctctgcatagccgcgccaatccccaaaccagcttctctggccacacggtgggacagggcggttcccacagctcctgagcctgccccctgcctggcctgctccagcgggcggccgagttagggaagcgctgggctccaccataccgcggtgttctaaaggagtgggaacaatgaagatcagggttgcagagcctgtggcctttgctagcttcatgggaaatcttgaaaagagaaaacgaagggcttcagtaagccacccatggacagcaggcatgcggtggaaggcggagggcttctgtggcagcttcgcaggtctctcatctgctgcagaccccctgacaggctgagggtcttgctgtcgggtagcgggaccagatgagcctgaatgtggctctgcggctcacaggacaagtgtaccttgagagctgctgccgccgcctggatgtttgctgggtgagctccagattcacgggagccctttgtgccagcatggccgccccaaccccatggggaaagcagatctccctcacctgggaatctggcagagacctcaggcagtgccccatctttcatgacctgcctggtccaggtagaggagtcaagtcctgctccaggagcaggtgcagggcctggcctgggtgccgagagtggggtgaggagggaggagtaacgaagaaaggcagatgggcagaaagtgccacattggggcactcaagtggctctgtttaatattccagcagggacactgagaccgagcccatccctgctgggagagcttctcgaagctggttggtggctgacaggcagggagtggggtgctggggcctcctcgggaggtaggggtgctggggccctgctcttgacagcactgtgccatagctccgaggtggctgctccccatgggccagggctggtggtgccagaaaatgggatctgggctgaggggctctgggctggcagaggtggggcggggggtgactggcaggcatcaagatggggggggacaagcacggtgcccccacccatggggccgtgtggggctgatggatagtgggactccagcatgcagcagatgatggagccttgctcaactcagaagaggaagagcaggagagcgctggtggatgagagcaaccctgatgttccagggcccttggccacgtccaccacacagaggggccacgtccacacagaggggccacgtccaccacacagaggggccacgtccaccacacaggggccactgggcctgcgtatatctccttggcctgcgagggtatcatcatttcctgacctgtggaacaagtcattaagccaggaaggacttgagttggagcccctaaaacggcccccactccttgccaggatggtggacaggaagcagtgccatgttctgaaggagctgcaccagcccatgctgctgtggaagacccaagggaggcaaagacggtggctccagatggcggcccccattgggaccctgctcacatcacccactggccctggaaagccggggtgggcctgggcaggtgaaccctgaggctccgccaggagcagccccagctacagccaccatggatgtttgctgggttggatcagcactctcacctgctgaatggttttgcctgattcccactagcttgtcttgtgtgggaggccgtgttttctgcggtagagaagtgctctccataaaaacccagcaggcgtgctcctgggccctgcagacgccggatgtgtggccacagacgccatgcgacccaggactggagtcacaagattgggcgaggacaaagacccagcgaatggtgaacggccatgcaggatggggccgatcagttcagtaggagcaagtgcgagacctgcacaggacgggcgagggaggcgttggtccccagcctctgctggccttatcagaatgggctgttcttgggaagcccctgggtgtctgtggagctggagatgttgggagcttgtgccctcagcaccgcccactgacaccagtgggctcctgtgtgccctgcccaatcccaggcctcaggacacccagcaccctgggcccttctccactgccacaggccttaaggttggtcatcatgccgcccagcggctgagtcttacaataaaaattcagacacaaagcagtggcagccactctgtgctttagagttagaagtaagtcattaaaaatgttggcccagcaccttccctgcctgtttccaaaagctggccgcaatatcaaattcatgtccctggacaaggctccagtaaggcactgcctgcagtgtgcagagagcacttaggtggttgcagagcaggcagagacgaatgtggggagtggaagtcaccatatctgcccactcggcaggaggccgtccattcctgagacgcccccgggaggcaggctcctgtacggcactcatgctgggtacccaacccctacaacccaggcaaacccctaccctgggcagagaagggcctggacacaccaggggcagaaggagaaaggggatggagacaaacctgggtgggggtgacctgggggcagctggggtggggtgacacggggaccattggggtggggacacactccgggagggggagacacggggcagcaggggtgggggcacacctggagtggggtgacatgggggcccctggggtggggacacactcggggagggggtgacacagggaccactggggtggggacacactccgggagggggtgatacggggcagcggtgtagggaaaagagagatcagactgtcactgtgtctatgtagaaagggaagacatgagactccgttttgaaaaagacctgtactttaaataattgctttgctgagatgatgttaatgtgtagctttgccccagccactttgccccaacctggagctcacaaaaacatgtgttgtatgaaatcaaggtttaagggatctagggctgtgcaggacgtgccttgttaacaaaatgtttacaagcagtatgcttggtaaaagtcatcgctattctctagtctcaataaaccagaggcacaatgcactgcggaaagccgcagggacctctgcccttgaaagccgggtattgtccacggtttctccccatgtgatagtctgaaatatggcctcgtggaatgagaaagacctgaccgtcccccagcccgacacccgtaaagggtctgtgctgacatgggttagtaaaagacgaaagcctcttgcagttgagagagagaagtccactgtctcctgctcgccgctgggaactgaatgtcgcggtgtaaaacccgattgtacatttgttcaactctgagacaggagaaaagccgccttgtggcgggaggcgagacatgtttgcggcaatgctgccttgttattctttactctgctgagatgtttgggtggagagaaacataaatctggcctacgtgcacgtccaggcatagtaccttcccttgaacttaattacgacatagattcttttgctcacacgtttttgctgacctcctccttattatcaccctgctctcctactacattcctttttgctgaaataatgaaaataataataaaaactgagggaactcagaggccggtgccagtgcaggtccttggtatgctgagcgccggtcccctgggcccactgttgtttctct

SEQ ID NO: 120752 - DNA, 576 bp, Homo sapiens
  Payload ID: 3654
  Gene Symbol: CCDC127
  Gene Name: coiled-coil domain containing 127
  ENST ID: ENST00000441693
  CDS Start-End: 370-576
tttctccactttccccaaccagattgtgagtcgctttcatcttaagttcttgttttttttttcctttttctttttctttttttttgggggggacggagtctcgttctgtcaccaggctggagtgcagtggcgcgacctcgactcactgcaacctccacctcccaggttcaagcgattctcctgcctcagcctcccgagtagctgggactacaggtgcccgccaccatgcccggctctggtctagtttttttcttctttgaatcccgtagggcctcagtgctgtgcagcaagcacatagttaaaactgaagaaaaatttcttgaataaaagtagttaacgtttttattctttacttcaaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggat

SEQ ID NO: 120753 - DNA, 4544 bp, Homo sapiens
  Payload ID: 3655
  Gene Symbol: CCDC129
  Gene Name: coiled-coil domain containing 129
  Uniprot ID: Q6ZRS4
  ENST ID: ENST00000319386
  CDS Start-End: 994-3684
atcctcccagaaacccagccggcttcacctctcaccaacagtggctgcgggactttccagcacctagcctgggcattcccacagcccagagggagctcgtcccagacaaccaagaggaaaagaagggaaacaagaaagagatggagacccatcattgtggccaacgaccccacgaagagggaatagcggtccacgcacgggacccagcctccgatcaagcccagcaggcgccgggtgcgcctgtgctgggaggcagagcccacgcccacccggaaccgcgccggccagcgaggtccgtgcgcagccccggctgccgcctgcgcttctccctccacacctcaccgttagcagagggagccggctccggcctcagccagccccagagacaggcccccacagcacagcggcgggctgaagggctcctcgagcgtggccagagcagacgccgaggctaaggaggtgccgagagacagcgagggctgctagcacattgtcacctctcaatactggaactcagaataagaggtctccactgttctgagttatgggagaaagatgggtgtatggtagacagaatagtgcctccccacaacaaagatgtcaacatgttactgtgtgtgttaaaagggactttgtaggtgtgagtaagttgaagatcttgagaagaaaagattatcctgggttttttgggtggggccaatgtcataaaaaggtccagataagaaagaggcagaagagtcagggtcagaggaggagccatcatgataggagcagagaagcagagtcaggagagttgatgctacactgctaactttgaagatgaagaagccacgagctatggaatggagacagcctctgaaaggcaaggagatggatttcctttagagcttccaggaaggagtgcaggcctgctaacagatacgttttagcccagtgagactaatttttagacttctgacttccaggaccgtaagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgccaacccattgtcagctatatctctcatattctaccctttggttaaacccaagaggagtttagaatactctaatactcattcagtatagaataactgagcacctagtatgtgcctggcacagagtatgcaacagtgactaaatagtatacggtctctgccctgctagaacttacagtgtagtgggggagatagaattgcaaacaaaaagtatctgagacagacctcagtcaatatagaagtttattttgccaaggttaaggatacacacccagaagacaggtctgtgcctttctccaaagatgattttgaggccttcaacatttagtggggaaagggtgctaatggggaaagaggtgtgggtacataggaggcaaacagttgcatttttttgagtctgatcagcttttctcatgagagaaggggtagaggaactgtcacttatgcattcacctagctcagtggatctgcacttttacagaaggtaaaataaacatagggcagaggaagcaatcagatatgcatttgtctcgggggagcagagggatggctttgagttctgttctttgtcctgtacctattaagagaagctatcaatatactttgtcaggataaaattcaacagaactgttttagactaaagattttagggaccacaaggaatttcccagtgggcaaattgtgagggaggtatttagcttttaaaaaaatctttgtagctatctcatttagaaataaaatgggaggcagattgcctgatgcagctcct

SEQ ID NO: 120754 - DNA, 3269 bp, Homo sapiens
  Payload ID: 3655
  Gene Symbol: CCDC129
  Gene Name: coiled-coil domain containing 129
  Uniprot ID: Q6ZRS4
  ENST ID: ENST00000407970
  CDS Start-End: 39-3173
tgacttccaggaccgtaagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgcca

SEQ ID NO: 120755 - DNA, 3773 bp, Homo sapiens
  Payload ID: 3655
  Gene Symbol: CCDC129
  Gene Name: coiled-coil domain containing 129
  Uniprot ID: Q6ZRS4
  ENST ID: ENST00000409210
  CDS Start-End: 185-3043
tgagtaaacagggtagcatccttttagctggttgtgctttgactaactgatctgttctttcttacttgtagaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggttgggcttttgacctccccttctccatgtagactccgagctctcctgcagtttcttccttgctccttccctgtaacgcctacggaatgaagaggaacacctggctctaggatgtccctcacctggcagccatctgctttaccagtctcatttcctgctcatccctcagatgaatctccaattctattcccctaaaccacctcctgtgttcctgcttcctctcctttgctgaaacaaatgaagtatctcaccagtaagtcctagggcagaccccatctcctacacaggctttccttgatgatctgtggcagaagtgatccttattttttgaaactcctatatcactttgcttttttgttaaaacactgaaaacctcctgtcttgtgttaccattatctgtgtaggtcatatcttctctagtaaacttaaagctatttgaggactgtgtagtacctactaccctgtgtttaagagagactatctggaggaaagtacagactcctttctttatcatgtgtgacctcgggcacttgctctctttaccctagtttcttcctctgtaaaatagggagaagaaaaacaacatagagttgttggacagaataaataccatgaatcctgtgcagtgtttaatccaatgtccatcacgtagtaagtgttcaatgcatgttggctattattacaagtgcacataccaagaactcaataaatgctaactgt

SEQ ID NO: 120756 - DNA, 566 bp, Homo sapiens
  Payload ID: 3655
  Gene Symbol: CCDC129
  Gene Name: coiled-coil domain containing 129
  ENST ID: ENST00000409717
  CDS Start-End: 140-566
agatggctcaggagtggagcttttgtggcaggtgggtagaggctgctggagggggctttcatgatcatctgctttgagggataaacattgcttgtcccctcctccaactaaggaagttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatag

SEQ ID NO: 120757 - DNA, 558 bp, Homo sapiens
  Payload ID: 3655
  Gene Symbol: CCDC129
  Gene Name: coiled-coil domain containing 129
  ENST ID: ENST00000456011
  CDS Start-End: 55-558
agatggctcaggagtggagcttttgtggcagttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattc

SEQ ID NO: 120758 - DNA, 3611 bp, Homo sapiens
  Payload ID: 3655
  Gene Symbol: CCDC129
  Gene Name: coiled-coil domain containing 129
  Uniprot ID: Q6ZRS4
  ENST ID: ENST00000451887
  CDS Start-End: 95-3283
atagttctgcagtcacaagggctttgtagtcagtcttagctgctggaacattcaaggagacaaaaaggcacagaagatctccacacatactttgatgccaactacagcaagttgcaagaccatttctctgctgaaactcctttattctgttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgaattattgtctgcagagctggatcccttttttttttcttcaaaagcaaataactctgctaaagatgaaaaaataaaatcaaaagactttctgaagacacaagactctggtctgttgtaattgtttttctttgttgagaaaataatcagtttccagagtataacacatgtcgaacaaaatagaacatttgtaaagaggttagagtatcaaagtggtgcccctttgagaagaaaaagttttagagtgttttcatgtggaatggtgggttgcatacgtaatttcaaattgtaatttaaaacaacaaattgttcatgatgtgcgagaattgtaggttattaaaagccttgttaaattgtttttcttgaaaattgagagaacaggaacagaagccaaaatatggacggcacctttctctagcccaaactcagcctctaattgcctgatctta

SEQ ID NO: 120759 - DNA, 582 bp, Homo sapiens
  Payload ID: 3655
  Gene Symbol: CCDC129
  Gene Name: coiled-coil domain containing 129
  ENST ID: ENST00000454513
  CDS Start-End: 92-582
cacacatactttgatgccaactacagcaagttgcaagaccatttctctgctgaaactcctttattctgttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaat

SEQ ID NO: 120760 - DNA, 4142 bp, Homo sapiens
  Payload ID: 3655
  Gene Symbol: CCDC129
  Gene Name: coiled-coil domain containing 129
  ENST ID: ENST00000615280
  CDS Start-End: 118-3282
gtttccttcaggaactttcagatggctcaggagtggagcttttgtggcagttcctgacaggataaggacaagaagcaacacacagaagagaaggaaaaagaaagaaaactgaccaatatgagtgttagtttgcagaattactctcctatgatggcacagaaatcacaaggatctgacaaccttcaggaaggccaggaaaagagcaagagagagatcctgaagtgcaccaaaagcgcgtgggctccgctggatgagtggctgccccctgaccctgaggaggaaagccagagtctcaccatccccatgctggaagattccaagcaagaaagtattcagcagtggctggactctggattctttgtctctgcaaatgaaaactttcaacaagtcattgaccgcactgtttctttgtatgaacaagggatggttcaaatgactgtgaaagactacatgagatctttgcatcagttttcagaaactcccatcctatccagagggaccagtttcaactcttgctattctactgcaagtgtaccacaaagcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtccaaagctttgaagaagagactggtaatcctcttgacatgacttcaggaactgtaggtgccagggtggacagagcaaatagctgccagtctgacagcagcgggttcctggaggagccgctggaaccgctgcccctccagatgccttccttgccaaacagccagagtcctgctgagaatggaggtagaaagccaagagatcagagccacagcttagtatcatcccaggactgtcagctagagtcggatgggccagattccaaaagtagggcgagcatgtctttttcaagccaagaagcgaatgccttggaacaaagggcctcagtatctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttcctgcacagtccatgagatggaagccatgaagacgatatgccaaagtttccgggagtatttagaagaaattgaacagcaccttatgggacagcaggccctcttttccagggacatgtcagaggaggaaagggaggaggccgagcaactgcaaacgttacgtgaggccctgaggcagcaggtggcagagttggaatttcagttaggagaccgggctcagcaaatcagagaagggattttactgcagctggaggttctcacagcagagccacctgaacactattcaaatctgcatcaatataactggatagaagaaagcaatgggcagacttcatgttctaaaatccacccaggcatggccccgaggactgtgtttcctcccgatgatggccaggaggctccctgttcaggtgggacccagttggctgccttcactccacccaccttggagaacagcaccaggatgtctccttcatcatcagcttgggcaaagttaggtccaacccctttgtcaaattgtcctgttggagaaaaggatgcagatgtcttcctctagatcagagcaggtttgttaaccttcatacaaaatataaaggcccagaacagatgtagcaaggaaatttcaattttccccaaggagaagggtctgccaacccattgtcagctatatctctcatattctaccctttggttaaacccaagaggagtttagaatactctaatactcattcagtatagaataactgagcacctagtatgtgcctggcacagagtatgcaacagtgactaaatagtatacggtctctgccctgctagaacttacagtgtagtgggggagatagaattgcaaacaaaaagtatctgagacagacctcagtcaatatagaagtttattttgccaaggttaaggatacacacccagaagacaggtctgtgcctttctccaaagatgattttgaggccttcaacatttagtggggaaagggtgctaatggggaaagaggtgtgggtacataggaggcaaacagttgcatttttttgagtctgatcagcttttctcatgagagaaggggtagaggaactgtcacttatgcattcacctagctcagtggatctgcacttttacagaaggtaaaataaacatagggcagaggaagcaatcagatatgcatttgtctcgggggagcagagggatggctttgagttctgttctttgtcctgtacctattaagagaagctatcaatatactttgtcaggataaaattcaacagaactgttttagactaaagattttagggaccacaaggaatttcccagtgggcaaattgtgagggaggtatttagcttttaaaaaaatctttgtagctatctcatttagaaataaaatgggaggcagattgcctgatgcagctcct

SEQ ID NO: 120761 - DNA, 2943 bp, Homo sapiens
  Payload ID: 3656
  Gene Symbol: CCDC13
  Gene Name: coiled-coil domain containing 13
  Uniprot ID: Q8IYE1
  ENST ID: ENST00000310232
  CDS Start-End: 85-2232
agggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatccagtctgtgaagcaggagctgcggatggcacagaaggttttggccagagaggttggggaagacatcaacgttcagcagctcctatcttcgccagggacctggaggggtcgggctcaacaaattcttgttttgcagagcaaggttcaagagcttgagaagcaattgggccaggcccggagccagtctgcgggaacagccagtgatgagttgtctgtctatccagacccaaggaagctgtcggcacaggagaaaaacctgctgaggatccgcagcctggaaagggaaaaacaggaaggcttggagaaacttgccagtgaacgggatgtcctccagagagagcttgaagagctaaaaaagaagttcgagggcatgaggtctcggaacaagctgctgtcaagtgagatgaagaccctcaagagtcagatgggaaccctggtggagaagggccggcatgatgacgagctcatcgacgccctcatggaccagctgaagcagctacaggagatcctaggcagcctgagtctgcaggaggagaaaacgcgagtgtcccagcaccacctggaccagcaactgaacagcgaggctcagcggagcaacagcctagtcgcccagctgcaggccatggtagctgagcgggaggccaaagtgcgacagctggagatggagatcggacaactcaatgtgcactatcttcggaataaaggagtgggtgaggggtccagtggccgcgaggtcagccctgcctatacccagttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctaggttctcggactccccagaacaaaaaggctggcaggcacaagtgtcagagatcaaggccctctggcaggctgccgaggtggagcgtgaccggctcaccgagtttgtcactgtcctgcagaaacgggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacaggtctgcccacctctaacaacaggcacaacccaaccgggagcgagaagaaggacccatcctttgcccagctctccgatgtgcccgtggaatcccaaatggaagagctgacaaccaggctggccatccaggtggaggagaatgaaatgctaaaggctgccctgggcagtgccctgcggggaaaggaggaggacttccggatgtaccatgagatcctgggccaggtgaaaagtgtcttcctgcaggccctgcggcagcagaagacaggcaagcaataggatgacagcccagtgtcggcctggccgggtgggcagcctcaggtcttgagaggataagactctgtctgaggactccatctgctccgggaagccagcccagggcagccagctcaaccacttctaccagaagaggctccttaaggatgaccaaaaccaatgtctcaggccaggaaggcagaagagaagccctggtgggacactgcaggagaccctgggctggctgggttacagcagcagggaggcccagcagcccactggcagaggcgagagctctgggatggcaaggcggctgtgaatggacagatgcagtccctcgggcaggtgttcatcgccctcatcctaggtactagccctggatgtccccatggcttcacacacagaagagcccttggttaccctaagtgggcatatcccccatgccactcagccctgccctatcccctcacccccatcccggctccatctgtagccgtccacaccctacacagacttggggcactatgctctcaaccagtttgtcagcccactcctcaggacacttcctcaggtgcagacccttggacttgtaataataataagtattttcataatcactgcagctcccagtgagtgagcatctactgtggcaacctgaccccattcagtcctctaatgacccaggggtttgttgtcttatttgacagatgaagaaactgaggttcacagaaagaa

SEQ ID NO: 120762 - DNA, 1792 bp, Homo sapiens
  Payload ID: 3657
  Gene Symbol: CCDC130
  Gene Name: coiled-coil domain containing 130
  Uniprot ID: P13994
  ENST ID: ENST00000221554
  CDS Start-End: 378-1568
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttcttc

SEQ ID NO: 120763 - DNA, 694 bp, Homo sapiens
  Payload ID: 3657
  Gene Symbol: CCDC130
  Gene Name: coiled-coil domain containing 130
  ENST ID: ENST00000588809
  CDS Start-End: 1-571
caaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggtgaggggggctccagcccggggtcagagaggatgcatggtggaccaaggcccgggtccagccctccccccaccacatcctagctttgagcaggccactgtaccctctgagcctcagtttccccatctgctacatggtgaccatgccctgtcttaatccattctggctactataataaaaaataccatagacagaaacagtagaaa

SEQ ID NO: 120764 - DNA, 1922 bp, Homo sapiens
  Payload ID: 3657
  Gene Symbol: CCDC130
  Gene Name: coiled-coil domain containing 130
  Uniprot ID: P13994
  ENST ID: ENST00000586600
  CDS Start-End: 504-1694
atgcgcctcggagctggcttcaaccagcgaaggctgaacccgcttccagggtcctcgccgagctgggagttaggatccgagggggccaagagggataagaaaacttctctgggtgcccacgtggtactgagcgcccttgggagggctctggagaagaccatcgccttccagggtagctccctccctcaaagggaaggaaactgaggtccagaaaagttatgactcgccccaaggggattgcctggcaggacgtgaaggggaagaggcccaccctggagtaaccctcactggagaatccagagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttcttccctg

SEQ ID NO: 120765 - DNA, 914 bp, Homo sapiens
  Payload ID: 3657
  Gene Symbol: CCDC130
  Gene Name: coiled-coil domain containing 130
  ENST ID: ENST00000586666
  CDS Start-End: 203-914
cgcgctctcagcgcgcacttccgggcacggtcagggcgtgacgtcgggaggagggcagggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctccc

SEQ ID NO: 120766 - DNA, 720 bp, Homo sapiens
  Payload ID: 3657
  Gene Symbol: CCDC130
  Gene Name: coiled-coil domain containing 130
  ENST ID: ENST00000589096
  CDS Start-End: 1-183
atgcagacggaccccgccaactgcgactacgtgatcgtgagtggcgcccagcgcaaggaggagcgctgggacatggcggacaatgagcaggtgctgaccacaggtgagcgccacccacttacctgcctgggggccctggccctgagtctgcgctggggcccccaaagcccagccgagctctgatcgttgcagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggtgaggggggctccagcccggggtcagagaggatgcatggtggaccaaggcccgggtccagccctccccccaccacatcctagctttgagcaggccactgtaccctctgagcctcagtttccccatctgctacatggtgaccatgccctgtcttaatccattctggctactataataaaaaataccatagacagaaacagtagaaatttggctgggcacagtgactcacgcctgtaatccagcacattgggaggatcgcttgaggccaggagttcaagatcagcctgggcaacatagtgagacaccaccccccccctcccccagcatctctaaataaataaataatagaaattaa

SEQ ID NO: 120767 - DNA, 887 bp, Homo sapiens
  Payload ID: 3657
  Gene Symbol: CCDC130
  Gene Name: coiled-coil domain containing 130
  ENST ID: ENST00000585844
  CDS Start-End: 1-309
aagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactgtgcgtaggaggccagggggaaaaggggacagggaggctcagagttgcctggagatggggggtcctcagccatgagtggactctggtctaccagagggcagttctggaccccctcccctgccgcccctgaaatgtcctctcctctcctctagcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctc

SEQ ID NO: 120768 - DNA, 1270 bp, Homo sapiens
  Payload ID: 3658
  Gene Symbol: CCDC134
  Gene Name: coiled-coil domain containing 134
  Uniprot ID: Q9H6E4
  ENST ID: ENST00000255784
  CDS Start-End: 105-794
agttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttggaccgac

SEQ ID NO: 120769 - DNA, 525 bp, Homo sapiens
  Payload ID: 3658
  Gene Symbol: CCDC134
  Gene Name: coiled-coil domain containing 134
  ENST ID: ENST00000402061
  CDS Start-End: 105-455
agttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtgg

SEQ ID NO: 120770 - DNA, 4169 bp, Homo sapiens
  Payload ID: 3659
  Gene Symbol: CCDC136
  Gene Name: coiled-coil domain containing 136
  Uniprot ID: Q96JN2
  ENST ID: ENST00000297788
  CDS Start-End: 368-3832
ccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaagcaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattaca

SEQ ID NO: 120771 - DNA, 1689 bp, Homo sapiens
  Payload ID: 3659
  Gene Symbol: CCDC136
  Gene Name: coiled-coil domain containing 136
  Uniprot ID: Q96JN2
  ENST ID: ENST00000378685
  CDS Start-End: 51-1355
gcggctgcggcttctgctcagggaggcggaaggcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccgaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaatt

SEQ ID NO: 120772 - DNA, 253 bp, Homo sapiens
  Payload ID: 3659
  Gene Symbol: CCDC136
  Gene Name: coiled-coil domain containing 136
  ENST ID: ENST00000472049
  CDS Start-End: 237-253
tgctcagggaggcggaaggcggcggcgggagcggtcatggaggcgggcgccggagccggcgcgggagccgcgggctggagctgcccgggcccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggaggg

SEQ ID NO: 120773 - DNA, 624 bp, Homo sapiens
  Payload ID: 3659
  Gene Symbol: CCDC136
  Gene Name: coiled-coil domain containing 136
  ENST ID: ENST00000459946
  CDS Start-End: 319-624
cctccctgcgcacccggctcgggtccccgggctcgcggctgcggcttctgctcagggaggcggaaggcggcggcgggagcggtcatggaggcgggcgccggagccggcgcgggagccgcgggctggagctgcccgggcccagagggtcctggaacagcgggttctgaggaggctgggaggcagggctgagaggtggccgagagagaggagtcgcagagccgccagagacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccag

SEQ ID NO: 120774 - DNA, 3320 bp, Homo sapiens
  Payload ID: 3659
  Gene Symbol: CCDC136
  Gene Name: coiled-coil domain containing 136
  ENST ID: ENST00000494552
  CDS Start-End: 1-3104
agatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaagcaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaa

SEQ ID NO: 120775 - DNA, 1870 bp, Homo sapiens
  Payload ID: 3659
  Gene Symbol: CCDC136
  Gene Name: coiled-coil domain containing 136
  ENST ID: ENST00000464672
  CDS Start-End: 1-1647
gtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacatg

SEQ ID NO: 120776 - DNA, 552 bp, Homo sapiens
  Payload ID: 3659
  Gene Symbol: CCDC136
  Gene Name: coiled-coil domain containing 136
  ENST ID: ENST00000488925
  CDS Start-End: 362-552
agacccccaggtgctcccggcctccgcggctcccctttctccgcccaaagtcttcctccctccatcctggcctccaccggggcccggtctccatccttccggcctgggactgaggcttccgcgcaccggccgcatcctgcctggtggtccctccccagcgcgtctctccacttcagtccgacggtgcttccagccttcgggactgcagaccctacacctcctgcagccccggagactcctgagcgcggggcgagggtggggtgggcaaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctca

SEQ ID NO: 120777 - DNA, 723 bp, Homo sapiens
  Payload ID: 3659
  Gene Symbol: CCDC136
  Gene Name: coiled-coil domain containing 136
  ENST ID: ENST00000485998
  CDS Start-End: 313-723
gggggtcttccggccctgaggcttgatggggccaccggagggctcctcctaagagggtccttggccctggctcggtggggggtcgcggaaagcggagaggtcagggccctgccgttcgcccatccgggcctcgacttccctcctccggcccccaggctgccgaggggccaccgggcaggggtgggcagggcctggggccggagtcagcgcggactgctaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaag

SEQ ID NO: 120778 - DNA, 1720 bp, Homo sapiens
  Payload ID: 3659
  Gene Symbol: CCDC136
  Gene Name: coiled-coil domain containing 136
  ENST ID: ENST00000464832
  CDS Start-End: 45-1385
gcggcttctgctcagggaggcggaaggcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaatta

SEQ ID NO: 120779 - DNA, 2268 bp, Homo sapiens
  Payload ID: 3659
  Gene Symbol: CCDC136
  Gene Name: coiled-coil domain containing 136
  ENST ID: ENST00000487361
  CDS Start-End: 395-1942
gccctctttcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatca

SEQ ID NO: 120780 - DNA, 2468 bp, Homo sapiens
  Payload ID: 3660
  Gene Symbol: CCDC137
  Gene Name: coiled-coil domain containing 137
  Uniprot ID: Q6PK04
  ENST ID: ENST00000329214
  CDS Start-End: 404-1273
ggggtccttcggcggcggccagcgcgcgatcctcccggctccgtccccacatgcgggtggaggggccggggctcctcccggtacgtgcgggcccccggacagcggcctctcggacgtgcccttcggcgctgccaagacccgtcctggtacttgccgagccacggaccgcggcggctaccgcccggcctccctcgaccaccctccgcagcagcatcgcccgcggacgggatccggcaacccctgaccgtgagcggcgggcgctccggccaatcccggaccttcaggaagtcgcgccgctccagccagcgtgaggctgagcgcaggaagcggaagtgccgatcggtggggcggaaccatgcaggaaggcggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaa

SEQ ID NO: 120781 - DNA, 890 bp, Homo sapiens
  Payload ID: 3660
  Gene Symbol: CCDC137
  Gene Name: coiled-coil domain containing 137
  ENST ID: ENST00000574107
  CDS Start-End: 13-890
cccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagctgtgctgcagtggacatctgtgacagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaa

SEQ ID NO: 120782 - DNA, 1888 bp, Homo sapiens
  Payload ID: 3660
  Gene Symbol: CCDC137
  Gene Name: coiled-coil domain containing 137
  Uniprot ID: Q6PK04
  ENST ID: ENST00000575223
  CDS Start-End: 16-885
cctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctggtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagtttt

SEQ ID NO: 120783 - DNA, 708 bp, Homo sapiens
  Payload ID: 3660
  Gene Symbol: CCDC137
  Gene Name: coiled-coil domain containing 137
  ENST ID: ENST00000571916
  CDS Start-End: 1-186
gacgaacaggagattcctttccggctccgggagattatgaggagccgccaagagatgaaaaacccgatcagtaacaagaagaggaagaaagcaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccgggg

SEQ ID NO: 120784 - DNA, 437 bp, Homo sapiens
  Payload ID: 3660
  Gene Symbol: CCDC137
  Gene Name: coiled-coil domain containing 137
  ENST ID: ENST00000574200
  CDS Start-End: 1-133
gggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcgaggccgccacacttccccagagaaggggacgccttgaaggctccgcccgggaccccctagggagcgttcgctcggaccccttccccagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccc

SEQ ID NO: 120785 - DNA, 2383 bp, Homo sapiens
  Payload ID: 3661
  Gene Symbol: CCDC138
  Gene Name: coiled-coil domain containing 138
  Uniprot ID: Q96M89
  ENST ID: ENST00000295124
  CDS Start-End: 61-2058
gtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctaaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtaatactaatatacaagatggcgtttctagaatgtatgacactgaagtgactttttgtaaaaatatattaggaaaattatttcttaaaattatgtgattatttggaataaaattggtgcttatgtgagaa

SEQ ID NO: 120786 - DNA, 2364 bp, Homo sapiens
  Payload ID: 3661
  Gene Symbol: CCDC138
  Gene Name: coiled-coil domain containing 138
  ENST ID: ENST00000409529
  CDS Start-End: 63-377
gcgtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgtttaaaaaatgtttttacattttttctcagttatgctgttaatatttgaaaagcagttttatctttttaaagtgctatagtaaacttctagattgctgtgatacaattatttttttaaagcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtaatactaatatacaagatggcgtttctagaatgtatgacactgaagtgactttttgtaaaaatatattaggaaaattatttcttaaaattatgtgattatttggaataaaattggtgcttatgtgag

SEQ ID NO: 120787 - DNA, 1056 bp, Homo sapiens
  Payload ID: 3661
  Gene Symbol: CCDC138
  Gene Name: coiled-coil domain containing 138
  ENST ID: ENST00000456512
  CDS Start-End: 1-1056
aggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagaca

SEQ ID NO: 120788 - DNA, 539 bp, Homo sapiens
  Payload ID: 3661
  Gene Symbol: CCDC138
  Gene Name: coiled-coil domain containing 138
  ENST ID: ENST00000447782
  CDS Start-End: 36-173
ggttcccggggagactggtacggttgctgtgtgctatggagccgagggtcgtcaagccaccggggcaggatttagtagtggagagtctcaaaagccgctacggactcgggggcagctgccccgacgaggtgatttggatatctactctggagataaagttggttcatcgttaaaatattctgatgaaagcaagcattgtagaacaccattgggcagcttattcaagcacgtaaatgtgaattgatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctg

SEQ ID NO: 120789 - DNA, 2250 bp, Homo sapiens
  Payload ID: 3661
  Gene Symbol: CCDC138
  Gene Name: coiled-coil domain containing 138
  Uniprot ID: Q96M89
  ENST ID: ENST00000412964
  CDS Start-End: 67-1800
ggccgcgtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagctcgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtaatactaatatacaagatggcgtttctagaatgtatgacactgaagtgactttttgtaaaaatatattaggaaaattatttcttaaaattatgtgattatttggaataaaattggtgcttatgtgagaa

SEQ ID NO: 120790 - DNA, 540 bp, Homo sapiens
  Payload ID: 3661
  Gene Symbol: CCDC138
  Gene Name: coiled-coil domain containing 138
  ENST ID: ENST00000608781
  CDS Start-End: 1-120
tctaatgttattgatagtttgctccagatgacggtggaatctagtcatcctccatgcccttctgatgtccacatgtctcttcattttcttctcaggcctcctctttctctcaccatctaagttattgaaattcttgaaatcctaagcaggcctggcactgagaggtactctgtaagggagctgaaacttccagcctttcttcctattcacaaacccacctttacccgcccccaatgctggactttggtttttcatattgcttttgcagaactttaaaacatttgaatctttccttgatgagtttttgtcctgaggggccagtgcagttttcttgccactttgttttcctctcatataacttttccctgtcaataaggcatttaggctgagagaaaaagttattgagcatgtgcatccaaatttgagatgattgttatttcattacctaatgactttaacttctttgatactgtgtttgtcttatgaatataatggctttctcactttaatgaaaagttatacaataaaattgaaaagtaa

SEQ ID NO: 120791 - DNA, 3111 bp, Homo sapiens
  Payload ID: 3662
  Gene Symbol: CCDC14
  Gene Name: coiled-coil domain containing 14
  ENST ID: ENST00000310351
  CDS Start-End: 57-2651
ctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccaca

SEQ ID NO: 120792 - DNA, 3815 bp, Homo sapiens
  Payload ID: 3662
  Gene Symbol: CCDC14
  Gene Name: coiled-coil domain containing 14
  ENST ID: ENST00000409657
  CDS Start-End: 1-159
ggcgggcgggccaagaaggtccgggagcccacggcggttaattctttttaccgtgaggcttcacttccctcggtctgggcttctctgaggcggcgagagatggtcaggtctggagctcgaccgggccaggacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaa

SEQ ID NO: 120793 - DNA, 2962 bp, Homo sapiens
  Payload ID: 3662
  Gene Symbol: CCDC14
  Gene Name: coiled-coil domain containing 14
  ENST ID: ENST00000409697
  CDS Start-End: 88-2805
aagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactga

SEQ ID NO: 120794 - DNA, 567 bp, Homo sapiens
  Payload ID: 3662
  Gene Symbol: CCDC14
  Gene Name: coiled-coil domain containing 14
  ENST ID: ENST00000434954
  CDS Start-End: 216-567
tggttggttttgttttgttttgtttttgaggacccaaagcatcagaattgtacaaactattctctttcctattgcattttcccttgagaacatgaactgacaaggaacaagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaa

SEQ ID NO: 120795 - DNA, 3260 bp, Homo sapiens
  Payload ID: 3662
  Gene Symbol: CCDC14
  Gene Name: coiled-coil domain containing 14
  Uniprot ID: Q49A88
  ENST ID: ENST00000433542
  CDS Start-End: 62-2800
gcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccaca

SEQ ID NO: 120796 - DNA, 548 bp, Homo sapiens
  Payload ID: 3662
  Gene Symbol: CCDC14
  Gene Name: coiled-coil domain containing 14
  ENST ID: ENST00000417438
  CDS Start-End: 65-259
attgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaa

SEQ ID NO: 120797 - DNA, 1221 bp, Homo sapiens
  Payload ID: 3662
  Gene Symbol: CCDC14
  Gene Name: coiled-coil domain containing 14
  ENST ID: ENST00000419247
  CDS Start-End: 286-1221
ctaattactttcagaaagaatttgagatgattttctttagtaggggtgatagtggtaaagcccttctatgaagtatgtgatggattggactacttctgagagccctttcttctcttaaaatcttacggtaaaagtttttgaagaatcatatttcaagaacttttttcttcttccacattagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaagcactcctgaaaagaaatcaccactttctaagagactatcccctcagccacaaataagagcagctacaacacagctagtcagcaacagc

SEQ ID NO: 120798 - DNA, 864 bp, Homo sapiens
  Payload ID: 3662
  Gene Symbol: CCDC14
  Gene Name: coiled-coil domain containing 14
  ENST ID: ENST00000435910
  CDS Start-End: 1-112
ttaccgtgaggcttcacttccctcggtctgggcttctctgaggcggcgagagatggtcaggtctggagctcgaccgggccaggacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcac

SEQ ID NO: 120799 - DNA, 735 bp, Homo sapiens
  Payload ID: 3662
  Gene Symbol: CCDC14
  Gene Name: coiled-coil domain containing 14
  ENST ID: ENST00000426152
  CDS Start-End: 214-735
ttgagaacatgaactgacaaggaacaaggtgaaggagtttgactggactttagggataatataactcccttaaaagaagtgttaaaatgaaggagagattttacaaatgcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaa

SEQ ID NO: 120800 - DNA, 7917 bp, Homo sapiens
  Payload ID: 3662
  Gene Symbol: CCDC14
  Gene Name: coiled-coil domain containing 14
  Uniprot ID: Q49A88
  ENST ID: ENST00000485727
  CDS Start-End: 4594-6855
gaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaagaaaaaaatgacattaaattttgtcaagatagcatattgaaaatataatagaaaaatatttgtttatctgctataatatattatgtcataggtgttatcttcaggaaggcacactggacctgctaaattaacaaatggaaagaaagcgtaagtacttgaagacgtttacaacttcagatttcaaggaatttttcaggtctttgggctggatgacatgtcgtctaccccagaaaattaggtaggcctctaccatcacaagctctgaggaacaatttttcatgtctacccatgttaatcattttagtatttaacagtctttctgatcttcagaatgtgtttataaattcatcttgtacatggttggacaagctttcttgtctttgctggaaagaaaatgactacttactaatatattttgggaaaaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacaggctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatgtaagccttttttctcttagttatttaaagataatccttaattgtgggtattttgatcaattatcaggattatacagttgattttcattttaataatcagtattagttaggtttatgtgtgcttatgcctttctgtattcagcttctaatcactgagtagtccactttgcttgctatcattttctcaagaagaaaaatagaaaaagagactgtcagggttttgtaggagaaaaagttcaaactcagaatgacatttgggaggtatatagagtgatcttagtttcccctgccacttgttttcatagataatcataaattggttgtatttcaagtgtatacttctagtagttgctttaaaattattatatttatatatatatatatcctaagttggtcaagctgaacttgtcaagctacacagttaggatacatggtacataggaaggtaaaatcggatgaataaggaaaggctgctgctgattggtggtgagtatagccaagggtactttacaccctcacggctaacttttcctagtttagaacaagaaagttttgattatgttgtcccttggaggcctagaaaacaagatagcccaaaatgaagatgaaaaagtccacagtgggaattcagatggactagaattagactagccagttctatagttcaggtgggccagaaatgtcagcactgtagtacgtgcttagattcagcttgggcaaggaatgaagtttagaaagtcatataaagcagtagccctataaagagatcaggatttaagcaaggaggctgagaaagtgtcagtagagcattcatgggactagaggttgatgtttcagatagtcccaaggtagagaactaaggcaagggaaacctaactcatcttggaggccagtaatgatagctttatattatcttgacctgtgctattcaagatggtagccactggccacatgtggctattcagcacttgaaatgtgactagtacaaccaaggaattgaattttaatgttatttaatttaatttaatttaaaattaaattagaaaactgataattgatccagttattataaaacttttaagtatgtttggaataacttgggcatgtgaacctaccttttcaagtgtaaattttattaaatctaaatatagaccaagtatttctgatgagaatttagcatctagattgtgctttgtgtaaaatatatgctagatttagaagatttaatacaaaatttcagttatttatattatacactgaaatgttaatattttggatatattgatttaaatattatgaaaagtaattttacctattttatatggttactggaaatttcaagttacatatatggtttgtattatatttctattggacagcattggtctaagctcaatacactacagccagttttataagtaatgtttagttattttattgtgtaaataagattttattagaatgcagccaagctaatttattaatgtgtttttattagctgtttttgtgctgcagtgtcagagttgagtagttttgacagagatcatctggcctgctaaacctaaaatatttatttgacctttgaagaaagagtgctaaaccctggccttaactctttaaagcagaggcctttttattggggcccaactgagaaagaaaggagcggtagcacctgttcctccagtctcctactttttgtctgtaggcaggttatttcttatccagggcacctttcctcaaggaactattatttgcaatatatgtgactggcagtgggtgtcatggtatcaacttactggatcctgacttaactgcctctgtcggtcagagttccaacaagaaacagatggcaacactcaaattgaggtaattttaggagggtttatttacaaagggactcataaaggtatgaatagggtataggaaaaccacaggttttgcctactaggtcatgcgagcctagtgctagcagcagagcagcagagctgttatcatctctaggccataagggattaggagagagagaggttactggatctagaaagagatactgtttatagaatacgctaccttgagaagagcagtgagcttcattgaaatgacgaaggcagcccaaggtggccttatagaaagggagcaggaataagtgtatatcctgacttcatgcttcttcctttccttgatatgccaagactcccattggattgaacccaactgaagccctactgatgtatatcaggtctgggatttgactcttacaagctagtaagttagtcttactgtgtcatggatgctagcagaagacaagactgctgggtcagagacaaaggactttattactcacagcacaggaagcagtatgtgcatcagcatattgtgttggttctcattcaccctagttcccattggggtgatatggtggacccatatggatgctgcacatgccttaggtttaggttgcagctgaggaacactgagcttggggaatccgtcactttggtagtaagcagtaatcaagcctgtgcttgtcccagagggaaacattacctcatccttcaaggttgctcactgcagacacaaccctgagaagcggcccaggtaaggagtttaggtcaaagccttgcttttttggtatatacagcaagacatattgaaggactgtctttttgcagcccatatggatcagcattccagggagaccagggtgaagaccagtagaggtgggtttggattggcagatggaagattctggcattctgggtccatagcgttaaattcttatttggattacagccgaatcagcagttctggcctgtgatcagggtgcaatattcttattgttctttctcccatattttcttaatcagaaggaaggacctacttccacaggacaatcttctttagggttgcaatattagaaattagtttctagttgtgtgtgtgtgtggttggcagctgttaaccaataatacaagattttgctttgttaccacaatgctcaaaaatacacaaaatccaagctcataacttgttctctttaccgtctccaagtgaagtaatcataaagaactttaagcgatctattacagcatgttaactagtatccatgtattattttacttttaacacacattatcttgctattttgtgttaactgtcttctggggagtggcctccttatgtactttctatctgggatgatatgatcattgaatgcctacctgatcactgaatgcctatggagtcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaa

SEQ ID NO: 120801 - DNA, 6476 bp, Homo sapiens
  Payload ID: 3662
  Gene Symbol: CCDC14
  Gene Name: coiled-coil domain containing 14
  Uniprot ID: Q49A88
  ENST ID: ENST00000489746
  CDS Start-End: 3163-5424
gacaaatactgcatgattttacttacataaagtacctaaatagttaaaactcatagaaacagaatgtgagcatggattgggcgtgaaccagagggatttttgttttttgggtttttttttgtaaagaacagtattgggataattggcaacatgtgaataaggtctgaatattagattgtaattctgtatcaatgttaatttcctggttttgataattatactgtggttatgttagagaatggccttgtttttaggaaacatttaggagtaaaggagtattgtatctgcaaacttaactctaatggttcaggcaaaaagtactgctgtgtatatatattgagagagaatatggaaaatgtcaaggttcacagaatctgagtgaagcatatatagggcatctttgtactattatttcatagtagaaactacaaaaaaaaattgaaaggaattgttccaatatgacagttactgtttcaaggtgcttttatcatgggtagttttctttaccagattttctataatatagccttgtgtatattttttggagaaacaccatatgtaatcttacagttatgccagacatatacctcagacagtgtactttaattgtggtagttgtttttggactcgatccagggtatagtattatagtgtcatggcttggattttttattatgattccagccaagacatcgacataaatataccaaagggaaggaccctgagagtgtgatgcagagaccagtggtgtgatgttatacaaggtcttatttcctacattgttggttctcactgctggcttcatgaccctccatcataatccaagttatctcaagacgtataactcttaccaacccagtttttaaaaaatgtattctcagtgacattcttagaaggatggagcacatattcaagcatataatagaatgccgtataactttagaaagtttggtagttacagctcaaagctatctggagatgaaattaaatatgtgaagagaaattataaataaaactgccaacagtgactacatctggagggtggaactagggggggaatcagggactttctcatgtctatttaaaattattttgaataaagattatatttatctgatataaaattattaagatataaaatagtataccatggaaagtgtcccttctcgctctgtcccccagatactctgtttccctccccagaggcaaccatgattaactgtttctggcataactcccaagatactggatgcatgtaaaagcaaatgcttattttttcctgtttttctacacaaaaggttgtccattattgtcacttttaaaacaaaaaagtttaagaaaacaacagtggtatatgaatttaaaaagaaaaattaagacagtgagatgtagataaagagacagggtagagttctcacttcctggtctaatcaggcattctaaagaatgtacataaaaggaaccagagttaagaactctgtcctatatcatgaattaacttgcatgtttcaaagaatttgggactatagaacatattttgggattaatatagtctgaacttagtgtagtagttacttctggtttaaaatagtatctcaatttccttttcaccttaaatagacttaaggaacaaatatatgtgtagtttgcttgacgttttacataaaagaaatttaatatatgaattaaattataattgtgtatttttaggatatatcacattaattaaaacagtgaataatgtggtacatacatataatggaatatatttgacctcaaaaaggaagaaaaattttgacacatgctacaatatagatgaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaagaaaaaaatgacattaaattttgtcaagatagcatattgaaaatataatagaaaaatatttgtttatctgctataatatattatgtcataggtgttatcttcaggaaggcacactggacctgctaaattaacaaatggaaagaaagcgtaagtacttgaagacgtttacaacttcagatttcaaggaatttttcaggtctttgggctggatgacatgtcgtctaccccagaaaattaggtaggcctctaccatcacaagctctgaggaacaatttttcatgtctacccatgttaatcattttagtatttaacagtctttctgatcttcagaatgtgtttataaattcatcttgtacatggttggacaagctttcttgtctttgctggaaagaaaatgactacttactaatatattttgggaaaaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacaggctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcct

SEQ ID NO: 120802 - DNA, 4156 bp, Homo sapiens
  Payload ID: 3662
  Gene Symbol: CCDC14
  Gene Name: coiled-coil domain containing 14
  Uniprot ID: Q49A88
  ENST ID: ENST00000488653
  CDS Start-End: 92-2830
gacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttc

SEQ ID NO: 120803 - DNA, 770 bp, Homo sapiens
  Payload ID: 3662
  Gene Symbol: CCDC14
  Gene Name: coiled-coil domain containing 14
  ENST ID: ENST00000479903
  CDS Start-End: 1-770
agaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagactttttaaaactgtggacttaaatgttctgcaaagtcttacacaaaagcccaatacagtacatgaactacggaaaagcagaactgctctgaacaaggaagag

SEQ ID NO: 120804 - DNA, 1699 bp, Homo sapiens
  Payload ID: 3663
  Gene Symbol: CCDC140
  Gene Name: coiled-coil domain containing 140
  Uniprot ID: Q96MF4
  ENST ID: ENST00000295226
  CDS Start-End: 385-876
aagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcccggcgcgatctggccagttcttggggagcgcggacctgggactgcagagaggcgttttgaagagtgctgcgcgcacctgcctctcggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttacc

SEQ ID NO: 120805 - DNA, 441 bp, Homo sapiens
  Payload ID: 3663
  Gene Symbol: CCDC140
  Gene Name: coiled-coil domain containing 140
  ENST ID: ENST00000440903
  CDS Start-End: 391-441
ggaagataggaagagagaaggaaaataggaaaggaaaaagaaaagaggaaaagaagagagaggtacttttttttttaaaggcagtgagggagggagagaagaataaatctcacagcagctggtgtcctagttcatttgggtctgagaaaattatttttaggcaaacaaggaagacaggattccgccgcccgattctccagggcgggaagaataggatgtcttgtaaaaaataagactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcg

SEQ ID NO: 120806 - DNA, 3795 bp, Homo sapiens
  Payload ID: 3664
  Gene Symbol: CCDC141
  Gene Name: coiled-coil domain containing 141
  ENST ID: ENST00000343876
  CDS Start-End: 1-2685
agatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtgggtagcctataatgacaagccataaatggaaacaaattcaatcacagagaaaaatcattctgtgagcactaactgaaaggtttagggctagctgattaatattctatgacactgcaactctgcatgattcaatctcacatcagacccctctcattttagtagcagcatagttaatacctttaagaaaaataaaaggtaaccatataaagtactaataatttaacaaatttccaaagcactgtaggttggttgtgcttgttttcttctgtgtttaacattccacatttctaaagattgtgggttgaaattattttttattgtctatttccatataagcatggcatctgcttgctttaactacctttatgcaattgaaaatataagaatttgtttttatttccctttactctcatttacctctttcatctttttcctctttccaacagagtcacacgtgtcatctttgtaacattttgttttactaggatttctttttacaaattttttcaatgtgagaggtggaatataaatatttctgtcacagttcctccaggtgacaggcaataaactcatttttgaaaggtagtataataactgagctgtaaacaatatgatttcactctggagacatcattattttttagcctctttttttcagtaaaagcaaactgtagaatactggttttggatcacctactattggtaacaaaagcagttctttctcaatatgtgggttacttttaaacatttagaaaattctcatccttaagtaaatttatttcaggacaaagttacaaatctgcaaaagccagtttatacttataaactaagattaagtaaaatagcatttattgatcacaatgtttcagtagatattaaatgatcagtttcagttattgtgtgtgcccattgatggtacttgaaatatgaaccagttatctaaggaacttatgagaaaactttggtttctcaaattatttaaaaaactgcacttgtgctatattagtgcagtcacttttgctttttgttttattgtctttactgttgcatgttttttacaaatcaagagtgtcatatttatgaattttaaagatatttaattcattattaaatctcagttcactccaaagaaaaa

SEQ ID NO: 120807 - DNA, 6960 bp, Homo sapiens
  Payload ID: 3664
  Gene Symbol: CCDC141
  Gene Name: coiled-coil domain containing 141
  ENST ID: ENST00000409284
  CDS Start-End: 119-2077
agtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaaggctttggaagatcgggtatgggaactcttgcaggaagcagacaagacagctgaagagaacaaggatcagagtcaggtctatgatgccatggccgagactctgggtgaagcatgggcagctctggtgtccatgcttgaaagaagaacagagctccttaggttgacttctgaattttttgaaaatgccttagagtttgctattaaaatagaccaagctgaagatttcctccagaatactcatgagtttgagagtgctgagtccttaaaatcacttcttcagcttcatgaacatcatactaaagaactcttggaacggtctttagcccttttaaacaaaagtcaacaactcactgacttcatagaaaaattcaagtgtgaaggacctaatgtgaatcctgagttgactcagggagctcatagcagctgtctgaaggttgaccgccttcttgaacttctacaagacaggagaagacaactagacaagtacttgaagcaacagtggcaagaattgagtcaagttctgcagatatgtcagtgggaccaacaagaaaaccaggttacttgttggtttcagaaaactataagaaatttacaggaacaaagtctaggttcatcactttcagacaatgaggatcgaattcataagcaagaggaactgataataaaagcaaaggaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggcatttgatgtacttggaagagttgaagcttaccttaagctccttaaatcagagggtttaagtctggctgttttggcagtgaggcatgaggaattacacagaaaaattaaagactgcacaactgatgctttgcaaaagggacaaaccttaatcagccaagtagactcctgcagctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtggaaatgtcaattcagaaaatcagtccagtactttctaatgcaatggatgttggttctacccgttctgaatcagagaagattttgaataaatatctggaactagatatccaagctaaggagacatcacatgaattagaagcagctgcaaaaaccatgatggagaaaaatgaatttgtatctgatgaaatggtatcactttcctctaaagctagatggctagcagaagaattaaacctatttggccaaagcattgactatagatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggtaagaatggcattaaatggatcacaccttctgcagggatactcatcaaagtcaaaataataatttcaaaggttcagctgtctattaatcagcagttctctcctagggagttctctttagcttcattcaacctagaccagtcctgaagcccaacatttaaatgcttgcttggcctagaactttggttagtttataacaggaaggctgttttaactattaagaagaaagtgactgtaatccaaatgcaacattgttattattaaatagagtcctcagaagtccacccaaaagttctgtgttattttgaaagcatgcaacaaggtcctttcaaaatttctaggggctaaagacaacttctaagatgaatcttcttttgaagagtttcttaccatagcagatctctttgtagtgaagatccattgcatttagaaaaataccctaacctttaactgtcttgaattatatctgtaaaatattttagaatccttatatccacccataacccatataaaattccctgtaggatacttaaaagatagtccacttctctttcaatacctcaagtattttcctaatgaaactgctcatttgattgttggagaatgccagctgctagaaaccttctttttttaatgttaaatatatctgtttccgtatctactcctaatcatctgtagctacacagggacaaaaagtattcatatttaatttctcttacacatgaaagtccttccaacattaaaaacagttgctatgtctgagttttttctgcagcattaaaaatcctttccatcatttatgaaggagctttatttttctttctatgctgatccccccttctcaggattttctatggtttgtcaagatcattcattaaatgtaaccaaaaagtgaactacaggtgcaacacagagtacagtaaactggacattattattcactaatgagacctacaattatgctaacatttttagcagtagtttcactttgctggtacatattaagcttgtgatagaacaaaactctcataatatttttattgcagcttctgtcaaaccatgtctctcccatattatacctgtgtcagccatttaccttttttatacaaatgtgggcctttatattttttcttatttaattttattttgttagtcttcacacatgatcccatcttgctaaactaatttgaacctacctagtatattagccatctgtcttgggtttaattctgtagatatgacaagtaagctttctatggcagcaattagttcttaaatataaatgcctaaagggcagattggcattccagttcatgaagcagtctattgattaaaccagtttttaaaataatcatgaatgctcccaatagtacttcattcagccgctacttcataatctttgtattaagtctataatgggagactttctcaaataaactgctcaaaagaaggtttacctacctagtatcttatcaatgacatagacaatttgacataaatcaggttggctcctagcgatcaaggcattctttccaaaatgctcacaaagtgcttgataagtaatgaacttattgcactgattttcagtgtgaagcttaccaatctgtaaattgtgtagtccatcctttcctccttttgaaaatcagggcattttctgttctctaattttatggctcttctagtttctgtagattttcaaagataactgacagctgcaattttctctgtacctgggatgtgattaatctcagtctggagcctgaattcatttggaagagttaggttctaactaccctcatctacttggagctgcaattttctctttatcttgtttcaacttttgttgtttgaagaccattcttgataaacctacttggaaataaaatatgcattagctgattctcatttattcaacatgattcttaagcactaaagaaaacttgctaagcaatttgcccatgttcctatgtgatctaggtgctttactgcaaaaaaaaagaaaagttatttttcgtttagaacatttagaacatgtattatctatctatctatctctgtctctctctcacacttctacgtggttcaatcagtcttctcccatctgttgatgatgtatgtttctgatttacctaagggaattcaaatactttcaaactgcgtaattttgtctacctttttattactaacttcatttcagaaattttagttctggaatctacagtcggtacttttatttattaaattactgatgaaattctgtttcttgtctgctcttttcccatctttccaatactttcttgaactatattaaccctaggcacttaaagtgttcatcagctagctacaacatttgtacctggagctctttctttctttctttcctttcttttcttttttttttagatggagtctcgctctgtcacccagactggagtgcagtggtgcgatctcagctccctttaacctccagctcctgggttcaagcaattctcatgcctcagtcccccgattagctggaattacaggtgcctgccaccatgcccggctaatacttgtatttttagtagagacgaggtttcaccatgttgaccaggctggtctcaaactcctgacttcaagtgatctgcccacctctgcctcccaaagtgctgggattacaggcatgaaccacagcgcccggccaatctggagctgtttctgttgtctaatttttctcttggtttccagtcctgtagtcctgtttcttggcagaactagcgaatatttatcaaatgccagacattatgtataaaaaattggaggatcagcagatggtgttttcttcttctagaaagggtcacccttctttctccaggcaggcattggtgggcaatcactcaagccaatcagaagctggcagagttgtgtttgcagtgtagtcctgtcccctcaggctcccagagttttgtattgagagccaagtgctttctctgacgtctctgcccctggcaggtcacaaactccaatctttgtttgggtagtctgctgaaaaactccactctgcttttcagaggccttttgcttaggttttttaatccactgcccgatatacccctggtattttgtcaacgtctttagaagatcattgtgcttgaagccctccaagtgtctgccaaaatctctggtgttttctcggctccagggaagtctcgattatcagcttcctgtctgcacagaattgggaaatccccctgggatgataggtgagctcacccctgtcaggttcttccctctctggagtcagcctctctagttccggttgtccgaccagttctctgcttccttcaaatggattccttctgcattttacccagcttttctaggtattctaagcaaaagcactgctctgccactggctaccccattctactcagaagtcctttgttacttatttagaatgtttaagattgtacagtcagatttttgtttttaaagatctgcaacaataacttattccaaattatattttgtatctatatctaaataaacttaggttatcataatattcaatgcccacttagatctcccagaaatagcatatattttactactgtgctttggtgttcttttatcttgatgtcataaacacggtcactctaccctaaggtctttaccactatcatatgataaataagttcctccttattgataaaattaaagcccacgtactaaggaaatttattggttagcaacatttggagagatgaaattgttggtaaagtaagtaaaacgattttttttattcttatatcttttggaccactaggcttttaaacaaacattattgttgaatcatggtgactagtttgcttgctaagaaggcagaggccagctggtatattcagttgagtgttctgttctttattgggttgtcgtggctcatattttcaagccagaaatagaaaaaatttcagttcatctaaaaatcattaagatcagagaaactgattcaggcccaaattatggcagacatcttgatgaaagtgctaatttattaatttataatggccaataccaagaatgctatctgggatacagccttcctattatcaaggtatctgaaaagcaagacatcagaaaaccattcatggtgcatgaatataaacgaaaaatgaatgctttagtggcctgtttagactggattatgacaaacattttccatgtcctacacagaagtaaaatgagtactgtgtttactaattagacctcaggcaaattattcaatcttcttgagtggccaaaatattcgtctgccaaatacatgatcacttttcacagatcctactagctagacatctacaaatcctactttagctctcctttctctagacctcactcagaccaccatatccttctgattaaagttgtcattggcatgctgcagtttcaaaatttatattaaattatataatacattacattctggttaatcatttctttaaaatatgtgaaagataattttatttatgataaaagtataatttggggtgaattctgctgtagttgtctaatatctttcataatttattatgtatcattattaataatgagggaatataacgttttattactagattcttaagttcatgggggaaatctcatttaggacctacagatatatatttttttggagttgccactttataatgtgtaaaataacataaaaatataagtgtgcaacatcaatatcatttaaaataattttaaaataaaatggcctatctttaaaatatcctgttaagtatttatgatactgtcaattgctgtcattgagatgatagaaatttgaagatttattgagaaagcctggctattaaagtaaaaaacataagaattgtttcgccaaatgaatgttcctgtgcattttttaaatgtttctacagaaataaagcacgcatagtctta

SEQ ID NO: 120808 - DNA, 2029 bp, Homo sapiens
  Payload ID: 3664
  Gene Symbol: CCDC141
  Gene Name: coiled-coil domain containing 141
  ENST ID: ENST00000446116
  CDS Start-End: 146-2029
ctgttctttccttttggcagagtaatcagtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaaggctttggaagatcgggtatgggaactcttgcaggaagcagacaagacagctgaagagaacaaggatcagagtcaggtctatgatgccatggccgagactctgggtgaagcatgggcagctctggtgtccatgcttgaaagaagaacagagctccttaggttgacttctgaattttttgaaaatgccttagagtttgctattaaaatagaccaagctgaagatttcctccagaatactcatgagtttgagagtgctgagtccttaaaatcacttcttcagcttcatgaacatcatactaaagaactcttggaacggtctttagcccttttaaacaaaagtcaacaactcactgacttcatagaaaaattcaagtgtgaaggacctaatgtgaatcctgagttgactcagggagctcatagcagctgtctgaaggttgaccgccttcttgaacttctacaagacaggagaagacaactagacaagtacttgaagcaacagtggcaagaattgagtcaagttctgcagatatgtcagtgggaccaacaagaaaaccaggttacttgttggtttcagaaaactataagaaatttacaggaacaaagtctaggttcatcactttcagacaatgaggatcgaattcataagcaagaggaactgataataaaagcaaaggcatttgatgtacttggaagagttgaagcttaccttaagctccttaaatcagagggtttaagtctggctgttttggcagtgaggcatgaggaattacacagaaaaattaaagactgcacaactgatgctttgcaaaagggacaaaccttaatcagccaagtagactcctgcagctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtggaaatgtcaattcagaaaatcagtccagtactttctaatgcaatggatgttggttctacccgttctgaatcagagaagattttgaataaatatctggaactagatatccaagctaaggagacatcacatgaattagaagcagctgcaaaaaccatgatggagaaaaatgaatttgtatctgatgaaatggtatcactttcctctaaagctagatggctagcagaagaattaaacctatttggccaaagcattgactatagatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaag

SEQ ID NO: 120809 - DNA, 2987 bp, Homo sapiens
  Payload ID: 3664
  Gene Symbol: CCDC141
  Gene Name: coiled-coil domain containing 141
  ENST ID: ENST00000443758
  CDS Start-End: 123-2987
aatcagtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaaggctttggaagatcgggtatgggaactcttgcaggaagcagacaagacagctgaagagaacaaggatcagagtcaggtctatgatgccatggccgagactctgggtgaagcatgggcagctctggtgtccatgcttgaaagaagaacagagctccttaggttgacttctgaattttttgaaaatgccttagagtttgctattaaaatagaccaagctgaagatttcctccagaatactcatgagtttgagagtgctgagtccttaaaatcacttcttcagcttcatgaacatcatactaaagaactcttggaacggtctttagcccttttaaacaaaagtcaacaactcactgacttcatagaaaaattcaagtgtgaaggacctaatgtgaatcctgagttgactcagggagctcatagcagctgtctgaaggttgaccgccttcttgaacttctacaagacaggagaagacaactagacaagtacttgaagcaacagtggcaagaattgagtcaagttctgcagatatgtcagtgggaccaacaagaaaaccaggttacttgttggtttcagaaaactataagaaatttacaggaacaaagtctaggttcatcactttcagacaatgaggatcgaattcataagcaagaggaactgataataaaagcaaaggaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggcatttgatgtacttggaagagttgaagcttaccttaagctccttaaatcagagggtttaagtctggctgttttggcagtgaggcatgaggaattacacagaaaaattaaagactgcacaactgatgctttgcaaaagggacaaaccttaatcagccaagtagactcctgcagctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtggaaatgtcaattcagaaaatcagtccagtactttctaatgcaatggatgttggttctacccgttctgaatcagagaagattttgaataaatatctggaactagatatccaagctaaggagacatcacatgaattagaagcagctgcaaaaaccatgatggagaaaaatgaatttgtatctgatgaaatggtatcactttcctctaaagctagatggctagcagaagaattaaacctatttggccaaagcattgactatagatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcag

SEQ ID NO: 120810 - DNA, 9127 bp, Homo sapiens
  Payload ID: 3664
  Gene Symbol: CCDC141
  Gene Name: coiled-coil domain containing 141
  Uniprot ID: Q6ZP82
  ENST ID: ENST00000420890
  CDS Start-End: 119-4711
agtgtgagctgagctctttccctgaatgaatccaagtaaccctggccttctgaaatgaccagcagacacacaactgtccagaggctgcccaaagtataaactctggttctaaagtaccatgtccagccaaggaagtcctagtgttgcgctttctacgacgacagtcagttcagttgctgtgcaggctggggactccaaaatcgttatagctgtcataaagtgtggcaaatgggtacaacttcaactggctgaatcacagcccaatcttctagaaattggcagcagtcaagatgaaaccaaaaaacttcttcatgatcatgaacttcttttggccaagctcaaggctttggaagatcgggtatgggaactcttgcaggaagcagacaagacagctgaagagaacaaggatcagagtcaggtctatgatgccatggccgagactctgggtgaagcatgggcagctctggtgtccatgcttgaaagaagaacagagctccttaggttgacttctgaattttttgaaaatgccttagagtttgctattaaaatagaccaagctgaagatttcctccagaatactcatgagtttgagagtgctgagtccttaaaatcacttcttcagcttcatgaacatcatactaaagaactcttggaacggtctttagcccttttaaacaaaagtcaacaactcactgacttcatagaaaaattcaagtgtgaaggacctaatgtgaatcctgagttgactcagggagctcatagcagctgtctgaaggttgaccgccttcttgaacttctacaagacaggagaagacaactagacaagtacttgaagcaacagtggcaagaattgagtcaagttctgcagatatgtcagtgggaccaacaagaaaaccaggttacttgttggtttcagaaaactataagaaatttacaggaacaaagtctaggttcatcactttcagacaatgaggatcgaattcataagcaagaggaactgataataaaagcaaaggaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggcatttgatgtacttggaagagttgaagcttaccttaagctccttaaatcagagggtttaagtctggctgttttggcagtgaggcatgaggaattacacagaaaaattaaagactgcacaactgatgctttgcaaaagggacaaaccttaatcagccaagtagactcctgcagctctcaggtgtccggcatccatgagatgatggggtgcattaagagacgagtggatcatctgaccgaacagtgttcagcgcacaaggaatatgctcttaagaaacaacaactaacagcctcagtggagggttacctacggaaggtggaaatgtcaattcagaaaatcagtccagtactttctaatgcaatggatgttggttctacccgttctgaatcagagaagattttgaataaatatctggaactagatatccaagctaaggagacatcacatgaattagaagcagctgcaaaaaccatgatggagaaaaatgaatttgtatctgatgaaatggtatcactttcctctaaagctagatggctagcagaagaattaaacctatttggccaaagcattgactatagatcgcaagtcctgcaaacttacgtggcatttctgaagtcatcagaggaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggcaaaagagaacgagatattagatgtgaaaaatgaagtgtacctcatgaagaacaccatggaaaaccagaaagcagaacgggaagaacttagcctccttcggctggcatggcagcttaaagccacggaaagcaagcctggaaaacagcagtgggcggcattcaaagagcaacttaaaaagacttctcacaacttaaaacttcttcaggaagcacttatgcctgtgtctgcacttgacctcggagggagcctccagttcattttagatctacgacaaaaatggaatgacatgaagcctcagttccagcaattgaatgatgaggttcagtacattatgaaagaatcagaggagttaactggcagaggagcccctgtaaaagaaaagtctcaacaactgaaggaccttattcacttccatcaaaaacagaaagagagaatccaggattacgaggatatcctgtacaaggtggtccagttccatcaagtcaaggaagagctgggacgtctcatcaaatcaagagagctggagtttgtagagcagccgaaggaactgggtgatgcccatgatgtgcagattcacctccggtgctctcaggaaaagcaagcccgtgtagaccatctccacagactggccctttccttaggagtcgacatcatctcatcagtgcagcggcctcactgctctaatgtttctgcaaagaacctacagcagcagctggagctccttgaggaggacagcatgaagtggcgtgccaaagctgaggagtatggacggaccctgtcccgtagtgtggagtactgcgccatgagagacgagataaatgagctcaaagactcattcaaagatatcaaaaagaaattcaataatttgaagtttaattacactaagaaaaatgaaaaatctcggaatctgaaggcgcttaaatatcaaattcagcaagttgatatgtatgctgaaaaaatgcaggctttgaaaaggaaaatggaaaaagttagtaataaaacctctgattctttcttaaattatccaagtgataaagttaatgtccttttggaagtcatgaaggatttgcaaaaacatgtggatgactttgacaaagttgtgacagattacaagaagaatttggacctgactgagcatttccaggaggtgatagaagagtgtcatttttggtacgaagatgcaagtgccacagttgtaagagttggaaaatattccacagagtgcaagacaaaggaagctgtgaaaattctccaccagcagtttaataagtttattgcaccctcagtgccgcagcaagaagaaaggattcaggaggccactgaccttgctcagcacttatatggtttggaagaaggacagaaatatattgagaaaatagtgacaaaacacaaagaggttcttgaatctgtgactgaattatgtgagtccctcacagagctcgaagaaaaactgaagcagggagatgttttaaagatgaatccgaatttggaagacttccattatgattacattgacttgctaaaggaaccagcaaaaaataagcagacaatattcaatgaagaaaggaataaggggcaggtgcaggtggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtacaagaagggccagaaattgtctgcagatgggcacttacaggttttacacaaggagacaaggcattcggtgttcattccaaaggtatgcaaggcagacgcaggcctctatgtggctcgggcccaaaactctagcggcgctctctcttccaatgtcatcctccacgtgacaggtaactgcaggctgccaatcacaagagtaaactggataaccctgtgtgtcgtctatgttagtgtgtccctaatgtactggctcctcacacaataactgtggtgttggcaccaatggacatcattctcatgtgcctaaagaaaagtgccgccgtttatcttcctgcacctcctgcaaagcatctcccaccaagtgtatctccagtctgatcaccatacttgtttggctaataccactgctaggtgaaataatcaaattttctggagcgtttaatatatttgagaagcttggtaaattatctgtagtggataagaacagatttttgtactctagaaacagatgttttcaacataatatgcagcaaaattattctatgcctattccctcctaatttaagggcgtgcagatgaaggctgacatcggcatagaaatgtgctaaatttcaaatatggttgttcaataatatatttttaattgtattttaaaacatccctttgtagggaatatcagtagaactattgaattgatgttgtatttttgcattagctgtcctttaattttgctttccatgtcttgatcttgttaccgaaatgcattctgtgtaatttcaacgtagactacgttcctgagtctgatgatgtcattgtaaataatcattcctcatgttgctctcacgggtttgacattggaggatagatgtgccatcaactttaaatagagtttccatcttttgtcagctctgcatgtcatacagcaagatggaacacaggttgcaagaaagaaccaacgttattcctgacattctattgatgtgttttgagcagcaatgtgtaaccaggtgtttctgcttctaatcttgattctgctgatgaccatttttatactttatggcaaagcctcattgcctcagtttcctgtctggaaaatgagttcatcatctacctcttgggcaattgagagttttcattttgtgtcttttaaacatctggaaaatggaaaacactgagggctaaggataatgatattgtttaatgtaatttgtcatcagaccggcctcctgctcactatttctttttttttagatgctgtttttttagaatattaaattaaaggagtgctgttaatatgtaatcttcaactagttccatggaggaaagtgatgttttatgaattagagcttaaattcctatctaatttctgaagactgcattcttttcaaagacttgaaattaaactcaggaggatacattttgtttgttctagggggaaacgtaatagaatggtatgagatgaattctatccttttacaataattattactataatattgaagtattctatgcctttctgaaacactttattcagaaaagatcattttttggcttccttttaaaaataagcttgaagtagggaagcatttgcttcttagattttaaatgtagtcttattatgctgaggaaaatctttagttgaaagaataattcattacagatttttgatgaagggaagaaattaattatgttgctggaagactgtctacaaataatcaaaatatttaaatgtaatgtattcaagttgttattaaaaagttactgaatgttatctgaagatgtgaaatgtgtagtcaagtaaaaagttggcgtatactttcttgggctgcatatccaatttaattaaaaaattaaatctcagtttccttctaaattttgatagaactatattaaaagcttgtatacacagcattctaggaaatttctcttaactatcttttttttgttttttttgttttttttttttttttttgagaaagagtcttgctctcttgcccagtgcagtggtgccatcttggctcactgcaacctccacctccgggttcaagcaattctcctgcttcagcctcctgagtagctaggattacaggcatgcctacctaatatttacatttttagtagaaaccaggtttcaccatgttggccaggctgggcctcagcctcccaaagtgccaggattacaggtatgagccaccatagccggcctcttgtatcctttttgtccaatttcaaataatgtgtgaatcttgcctaactgctgttgcccacgttgaagctaaagagtaaaaacctattcatgaacaaagaaggcaggtgagacccggtaacaaactgtctctcttcccactttctctttcttattaatttggcaggatctcccttcccattttgtcaacatggttgaatttgtgtgttggggttgttagggcatgggaattcctggtttgctttctctattgcatgcttgttcatgttaactctttggggagcagaatgagatacatatgcatccatggttatgatggaaaaaagcatgcaaaatccatttttagagagagagagaaagagaaaggtgggggtgggggagcacaaagatcagaagagtactatgctgatattcaagatatagtacagatagctttctgtgtacctatccatctacctattcatctgggctattgattgactcccacagcagtaaagaataattacgcagttattcttctggttatgttttaatttcaaaaagttaagtgtgattttcctttttgctgggatttctgtcttgagcaaataattattcttatgaaagtatcaattgcagttactggttaaaaatgtaagacctaggaaatttaagtgttgtttctattttaaggtatatacataatttataaccatttacttctagagaaaatcctgaatggttagtaatatcaaaacattttcaacaagaaaactaaaatgaaaagaaagtttaaaaattacatgtgttacagctcttttagaatttgtctagcaggttttctggtgaaaattaaactcaagattttcaccagaaaacgttttaaaacttctaaactcttaaacaaattataaatacttgatactttgaagaactgcaaaacaaaatgtttttaagttttcataaggcaaaatcattgagttttccagctttgattttccaataaaaggatgtataaatatttggtggtagtttttcacactcaattccaagagaaatttactgtaggaatctgtacatttgaatctctgaatattctatgatatttaaaatatttgaacaagatgcagaaaattttttagctatattaatcaataatggtaacctctatcactcataatcaagacacatacttaaaatagatgactacaagacccttctaactgctttgctcaaatttaaatttcctcaagtagttcatagaccctttacaacctggcctcccctctctggcctcggtttgatcccctcctattacccccaacccctagtaaagtgacatttaacttcagggttttaacatatcatgctcttctctccagccctttcttcctataactctcttactatcttcaccaccctatcttcatgtgacttaactcttgcttatgttccagttctgctgagacacaacttcccctgggaagcctcctgacccatcaagtccagagtagatggtcctgccatgtgcactgtcagcacctgcactgcccagccacgcccctgaatatacacaaaggaatcgcaggtttgagcatcagtctcctctggctaggctgtaagaaccttatcagcaggattcatgacagccctgttgtcattgtattgccagtacctaagacacagtcacactcagtaaactcttttgaattgaattgttgccaaaggtaaacaaagataaacctagcttgtttttctcccctttttagagggaggagaggggaaatgtaaaaagacaaagatgattctcccttcttatagacaggagtcaatccgaatcaggccctaacaatgaagcactcatgaaaatctctcacctcatctgcaaaacttgtgtgagaaccctccagaccctctgggctagaccctgattgaaaatttgaatttaaaaatagatgctggctccacggactaaaataatagtaaggaggaaagaggaaaggtccaggattgttgttcctggatcaatattgttccaacattttaaagtgttccaacattttaaaacatatgtacttaggcataaatcatcatccggtatgaggaactggatgcctccactctctatgactaaatccaaactgtcaaaaccagaatttatgtacttctttagaacactacgtaaatgatcaatatttaattgtagctggggctcagtagtctgggctgtgaacagatcttatttgaaaccagtatttcatacaaacttgtaaatataaagaaagccaaatccaagaacttaagagtatttgaattccaaatgaagaaaggaaagaatatcttattttgttctgctttatgtttgtctttattcatgaccatttcttactaaaaatcaccatctgaagcttttgaaactcctgttgtatgcacagcattttaagtgcagccatgaaataagttagttgaaacaaaataaaatatctccttccagta

SEQ ID NO: 120811 - DNA, 2835 bp, Homo sapiens
  Payload ID: 3665
  Gene Symbol: CCDC142
  Gene Name: coiled-coil domain containing 142
  Uniprot ID: Q17RM4
  ENST ID: ENST00000290418
  CDS Start-End: 160-2391
aagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctc

SEQ ID NO: 120812 - DNA, 3406 bp, Homo sapiens
  Payload ID: 3665
  Gene Symbol: CCDC142
  Gene Name: coiled-coil domain containing 142
  Uniprot ID: Q17RM4
  ENST ID: ENST00000393965
  CDS Start-End: 398-2650
ctgcataaaatcctactcgaaacgttcagaccacaggtggacccaagaggggctgcctctgccctcctagacccccactggtcttgtcataccgctcacctagcttgatccgccccacagtctttggaatcggcgccatcgcatctacagtgacccggaaatgaaaggtagtctagtatttgataccagccaaagggcggggtgggacagagtgggcggccatgtttgttaggggcagaagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcagatcctgcgcctgtcgccctaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctcaaaaaaaaaaaaaaaaaaaatccaagattaggcagggcatggtggctcacacctataatcccagcactttgggaggctgaggcaggcggatcacctgaggtcgggagttccagaccagcctgaccaacatggagaaaccccgtctctactaaaaatacaaaattagccaggtgtggtggcgcatgcctgtaatcccagctactcaggaggctgaggcaggagaatcgcttgaacctaggaggcgaaggttgcggagagccgagattgtgccattgcactccagcctgggcaacaagggcaaaacttcgtctc

SEQ ID NO: 120813 - DNA, 2309 bp, Homo sapiens
  Payload ID: 3665
  Gene Symbol: CCDC142
  Gene Name: coiled-coil domain containing 142
  ENST ID: ENST00000454193
  CDS Start-End: 1-1703
atcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcaggcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcagatcctgcgcctgtcgccctaggtctctgtacccttcagaccaccttgctctggttcctgggcagagctcagcagtacttggcagcatgggacccagcttccttcctgctcctgatccaaaaggacttacctcctctgttgcatgaggcagaagctttgtatagcctggcctcagaggaaagcttagctctggaagtggagcagcagctgggcctggagatccagaagctgactgcacagatccagctcctgcctgaagagtcactaagtgtcttttctcaagaatgtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctacc

SEQ ID NO: 120814 - DNA, 2806 bp, Homo sapiens
  Payload ID: 3666
  Gene Symbol: CCDC144NL
  Gene Name: coiled-coil domain containing 144 family, N-terminal like
  Uniprot ID: Q6NUI1
  ENST ID: ENST00000327925
  CDS Start-End: 121-786
gcttggcgtggcagtgatcgcttggcttggcatttctggcttagcggtcctcctttcgcagattggaaaccgcgggctatcctgctgggaggttgtggccgaggcagtagctcgctactgatggcctcctggggtggagaaaagcggggaggggctggggggtctccgaagccggcagtctacgccacgaggaagacccctagtgttgggagccaggaggaccagtggtacttggactacccgggggaccagtggtccttgggcttctcctacagctggtggaagaacagcgtcggcagcgagagcaagcacggtgagggcgccttagaccagctccagcacgatgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagctgctccaagccaggctgaaggaggagaaggaggagtcgcctgtggtacggtggagcagatgacgtggctctgcagcttgcctcatgcagttggtggtggagatggagaccacagctcgactggagcggtaggagggcacccacgggggcctggagagtattgtcatctgcatgagcaaagggttcatcaccacatctttgcaagaggaaaaagaaaggggaagaatcatgtgtctaatgttgtaaggtaaacattcacaaccaaaaacaaggttttattaacttttgcctttaagaacctgcagtgtttagccctctttgattcctagtattattacctttggtatgaactcttttattaaactgatcactctagaggtttatgcattttgtatcatttttcaagccaacagaaatgtgtaatgcctataattctgacactttagttatttttaaggctatgagcatgtaagatactgttggaagaatatgtataaataccactaggtagcttattttgaagagatagtatctaaatttttgtccagagtagattggttgcagtttcttaggtgtgtttcttaatacgttgcctcaatgttttaaagcatgtagaaatttgaatacagtttaacttcatatagtcctttgtttatagatttaatatttctaaagactaaagacatcacagctccctttaagattcagtaatattaataaaattttagaaatatagggttagaatccaacaaattcagaggaaaattgttaaattctatagctgtagagcagaaatgaaacccaggttctaagctctaagggggccatgaggtaccatacaggtgcatcagtgactgggcatagattcagcaaaattacaggatggttaagagagtgagctgtggagccaaactctatgtaacatgaatttttaaactgcctggtgcctcagtttatccatctttacagtggggactgtagtaagtttttctttttctgctcagttgtctgtcttgttgccactgttccctagtctgtcttgttgccactcagtgcccacatgagaggatctacggtaatttctgacagcctgggactccttaaagaaaaacagaaggtgctacaaaacccattttaggagaaacctctgttgtcctcatggaaccccaagaacttcaggcagacaggtctctctcaaaatctaaggctctcctctgttttgttttgcgttatctgaccttttaggtttggttgggcatcagaaatcagtcggggagagagatctaaagaaagttgtggatatgaagatgtatttatggtaaaaaagttatgaaggaaagaaatgttatatgagagaggatcttgtatggcaaattcttgtcctaaagtagaatgactaattatgaaagagggaaatacaggaaaagtcagaaagttcatgtcatagatggtctgtggaagttgtgctagggttcataaaatgagaaagaaaaacttacaactgctagatcttctcctgtctagaagtgttgtgtatgtgttggatatgtaaaggagccctaattacttggcttagaagaaaaggacggctcttaaatattttgtcagaaaaatagaatctccaatgccttttatttcacatgacttcagtaatctttgggaaataaagacagtgttaaaatcattggtaaaaaaaatcatcaaaatttatccattttgtctaatttaagtcagaggttaaattttagaagtgctttaacgtcataaattgattgactttggaaaattgttctgtttacctggtttggagctgctcaacttctaggtaaggcctgggggacaggtggagttagccatgtctcctagctatgctggaaagagtcagactttacctgcagttctgtcttgtatcctatacactgcacctggtacgttattaaaacttcctgctgcttctaatctctgagttccactttaaatttttccatcacttgaatactatcctctgtactaaatttttccgcaattaaatacttagaatcatttttgcccacttgacccaagcattagtgatatatctttaaaatacttataatgtgtcacaatatatttagcaaatgtagcgaatggcatttttacttttgtcagcatttacatagcatttagcaatgctatctcaagtatttttagtcatttgaatgttacataatatgcttttcctttgtttctatgtaaataaataggagatattcaataaatagtatcaattaa

SEQ ID NO: 120815 - DNA, 2214 bp, Homo sapiens
  Payload ID: 3667
  Gene Symbol: CCDC144A
  Gene Name: coiled-coil domain containing 144A
  ENST ID: ENST00000340621
  CDS Start-End: 170-1885
cttacccacgaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggtaagcctatagcagcgtttaacaggagacaattggtcaagcgtggtggctcacgcctgtaatccagcaatttgggaggccaaggcgggtgaatcacctgaggtcaggagttcaagaccagcctgaccaacatggataaaccccatctctactaaaaatacaaaattagccagatgtagtggtgcatgcctgtaatcccagttactcaggaggctgaggcaagagaatcatttgaacctgggaggcgggggttgtggtgagctgtgatcatgccattgcactcgagcctgggcaacaagagtaaaactccatttcaaaaaaaaaaagcaaaaa

SEQ ID NO: 120816 - DNA, 5545 bp, Homo sapiens
  Payload ID: 3667
  Gene Symbol: CCDC144A
  Gene Name: coiled-coil domain containing 144A
  ENST ID: ENST00000360495
  CDS Start-End: 77-2257
cggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaagtagttatgagagaattccaacaagaatggaccgatctcctaaaacaacaacctacgtcagaggctacctcacgttgtcacattaatttagatgagacacaggattcaaagaagaaattgggtcaaatcagaagtgaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggat

SEQ ID NO: 120817 - DNA, 5830 bp, Homo sapiens
  Payload ID: 3667
  Gene Symbol: CCDC144A
  Gene Name: coiled-coil domain containing 144A
  Uniprot ID: A2RUR9
  ENST ID: ENST00000360524
  CDS Start-End: 77-4360
cggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcaggatccagccaaactggactgcacagaattccacagtgctcgtccttctcctccagctctttgcacttgcttctttgctctatctgccaacctttttttctcatccttcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggat

SEQ ID NO: 120818 - DNA, 8686 bp, Homo sapiens
  Payload ID: 3667
  Gene Symbol: CCDC144A
  Gene Name: coiled-coil domain containing 144A
  ENST ID: ENST00000399273
  CDS Start-End: 161-4438
gaggctttgcggtggctgttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagccggcagtctacgccacgaggaagacccctagcgtcgggagccagggggaccagtggtacttgggctacccgggggaccagtggtcctcgggcttcccctacagctggtggaaaaacagcgtcggcagcgagagcaagcacggtgagggcgccttagaccagccccagcacgacgtccgcctggaagatcttggcgagctccacagagctgcccggtcgggcgacgtccctggggtggagcacatcttagctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtaaaggatattccctttaatttgacaaataacatacctggttgtgaggaagaagatgcatctgaaatatctgtctcagtggtattcgagacatttcctgaacaaaaagaacccagtctcaaaaatatcatccatccatactatcatccatactctgggtcccaggaacatgtttgccagtcatcttctaagtttcatttacatgaaaataaattagactgcgacaatgataacaaaccaggcattggacatatttttagtacagataagaactttcataatgatgcaagcactaagaaagcaaggaacccagaagtggttatggttgaaatgaaagaagaccaagagtttgatttgcaaatgacaaaaaatatgaaccaaaatagtgacagtggcagtacaaacaactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaagatgttcaacttcataaagatgttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcagaggattgtgaattgtctcactctgtttatgagaattttatgttgctgattgaacaacttagaatggagtataaagattctgctagcctaccaagaatccaagacacattttgtttgtgtgaacacttactgaaacttaagaataatcactgtgaccaacttacagtaaaacttaaacaaatggaaaatatggtcagtgtactacaaaatgagctatctgaaacaaaaaagacaaaattacagttagaacttcaaaaaattgaatgggagaaagagctgtacgatttgagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaacatttttactaaagggaaatattctatattatacatgtctgatgaaaatttatatagtattttaaataatgtttcttggcctcttcagctaacttttaagtggattttgcaaatgaaaaccagtattactgagttttacatactcgaactgcccaaatgtttgctgtttaaacagccaaataatcaagttgccattagtaatttagtggagccaattgatggcttgtttgtattttataattttatctttatacatagtgatagatttaagtttagatagacatcattttggtatactggtactgtggtcattgtcaatgtttggatgtattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcggaaagttaacatcaatacacttgatcatttaattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaactttttttatgataagatttagatgataattttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctattgtgaatagtgctgcaatgaacatacgtgtgcgtgtatctttatactagaattagttatattcctttgggtatataccaagtaatgggattgctgggttaaatggtatttcaggttctagatctttgaggaatcaccacactgtcttccacactggttgaactaatttacactcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggtcccgtttcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcactatgctgttttggttactgtagtcttgtagtatgtttgaagctgggtagcatgatgcctctagctttgctcttcttgcttaggattgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgaaccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagagagggcatctttgtcttgtgtcagttttcaagggaacgcttccaggttttcaggtactcaggcaacaaatagcgttacaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcactaggcagatcaccaagacagaaagtcaacaaagaaacaatggacttaaactataccctggaacatatggacttaacagatgcttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaa

SEQ ID NO: 120819 - DNA, 534 bp, Homo sapiens
  Payload ID: 3667
  Gene Symbol: CCDC144A
  Gene Name: coiled-coil domain containing 144A
  ENST ID: ENST00000420937
  CDS Start-End: 1-534
cactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagactcggagctgacatcagaggaagagcaagaaagacttaaaggatgcgaaaataagcagccacagaaaacgtctcaagaaccagaaatggctaaggattgcgatagagaggatatacctatatatccagtacttcctcatgtgcaaaaatctgaggaaatgtggattgaaca

SEQ ID NO: 120820 - DNA, 3333 bp, Homo sapiens
  Payload ID: 3668
  Gene Symbol: CCDC146
  Gene Name: coiled-coil domain containing 146
  Uniprot ID: Q8IYE0
  ENST ID: ENST00000285871
  CDS Start-End: 128-2995
ataccaaggacgcgacttcttgtttggagagggtggagctttggagtgagacccaggaggccaaatcccaaagagaaaaataggagcctaaataaggatcaggaccaagggaagggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagaaatggagaagaagatgaaaatattgagagaaagcactgaagaattacgtaaagaaataatgcagaagaaattagaaattaaaaatttacgagaagatttggcatctaaacaaaagcaattattaaaagagcagaaggaactagaagaattgttgggacatcaggtcgtcctaaaggatgaagtggcccaccatcaaaccattccagtacaaattggaaaagagatagaaaaaataacacgcaaaaaagtagaaatggaaaagaaaaaaattgtcttggaacaagaagtcaaaacgctaaatgactccctaaagaaagttgaaaacaaggttagtgctatagtggatgagaaggaaaatgtaataaaggaagttgaaggcaaacgagccttacttgaaatcaaagaacgagaacataaccaattggtcaagctattggaattagccagagagaatgaagcaacttcattaactgaaagagggatcttggatctcaatttacgcaacagtctcattgacaagcagaactaccatgatgaactttctcgtaagcaaagagagaaagaacgagattttcgaaatttaagaaagatggaactgctcttgaaagtgtcctgggatgcacttaggcaaactcaagcactgcatcaaaggcttctattagagatggaagctatccccaaagatgattctacattatctgagagaaggcgagagcttcacaaggaagttgaagtagctaagaggaatttggcccaacagaaaattatatcagaaatggagtctaagttagtagaacaacaacttgcagaagaaaacaagcttttaaaggagcaagaaaacatgaaagagctagtagtcaaccttctccgcatgactcaaatcaaaattgatgaaaaggaacaaaagtccaaggatttcctgaaagctcagcaaaaatacaccaacattgttaaagaaatgaaagcaaaggatcttgaaatcaggatacacaagaagaaaaaatgtgaaatttatcggagactgagagagtttgctaaactgtatgacaccattcgaaatgaaagaaacaaatttgttaacttactccacaaagctcatcagaaagtaaatgaaataaaagaaaggcataaaatgtcattaaatgaacttgaaattctgagaaatagtgccgttagtcaagaaagaaagctacaaaattccatgctgaaacacgccaacaatgttaccatcagagagagcatgcaaaacgatgtgcgcaaaattgtatcaaaacttcaggaaatgaaagaaaagaaggaagcccagttaaataacattgacagacttgccaacacgatcacaatgatcgaagaggagatggtgcagcttcgcaaaagatacgaaaaagctgttcagcatcgaaatgaaagtggcgttcagctgatagagcgggaagaagaaatatgcattttttatgaaaaaataaatatccaagagaagatgaaactaaatggagaaattgaaatacatctactggaagaaaagatccaattcctgaaaatgaagattgctgagaagcaaagacaaatttgtgtgacccagaaattactgccagccaagaggtccctggatgccgacctagctgtgctccaaattcagttttcacagtgtacagacagaattaaagacctggagaaacagttcgtaaagcctgatggtgagaatagagctcgcttccttccagggaaagatctgaccgaaaaagaaatgatccaaaaattagacaagctggaactacaactggccaagaaggaggagaagctgctggagaaggatttcatctatgagcaggtctccaggctcacagacaggctctgcagcaaaactcagggctgcaagcaggacacactgctcttagccaagaagatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctgaatatgtgaacaaatccaggcctctcaaggaaaagacttcaaccaggcttccttgtacccacaggtgaaaaatgtgagcataatacttctaatattattgataagtaaggtaaccacaattagtcagcaacagagtacaacagggtttctatttacccaccaactactatacctttcatgacgttgaatgggacatagaactgtcctacatttatgtcaaagtatatatttgaatcgcttatattttctttttcactctttatattgagtacattccagaaatttgtagtaggcaaggtgctataaaaatgcactaaaaataaatctgttctcaatgaa

SEQ ID NO: 120821 - DNA, 557 bp, Homo sapiens
  Payload ID: 3668
  Gene Symbol: CCDC146
  Gene Name: coiled-coil domain containing 146
  ENST ID: ENST00000415750
  CDS Start-End: 47-557
acatatcccaggaggcaatgcgcaggggagcacggaatcgtgaaaaatggaagacagtagcacagacacagaaaaagaagaggaagaggagaaagatgaaaaggatcaagagcccatttatgccatagtgcccacaattaacattcaagatgagcggtttgttgatttatctgaaactccagctttcatttttctgcatgagttacatgctatgggaaaacttcctggaaccagaatggcagcgttaaaagccaagtataccttgctgcatgacgccgtgatgagcacacaagagtcagaggtccaactgctacagaatgccaaacgtttcactgagcaaatacaacagcagcagtttcacctgcagcaagctgataattttccagaagcattctccacggaggtctccaaaatgagagaacaacttctcaagtatcaaaatgaatataatgcagtgaaggaaagagagttccataatcagtacagattaaatagcttaaaggaagaaaaaatcatcatagtaaaagaatttgagaagataacaaagccaggagtaa

SEQ ID NO: 120822 - DNA, 3122 bp, Homo sapiens
  Payload ID: 3669
  Gene Symbol: CCDC148
  Gene Name: coiled-coil domain containing 148
  Uniprot ID: Q8NFR7
  ENST ID: ENST00000283233
  CDS Start-End: 315-2090
atagagaccgatgctgttcagcgcgagagggcctggagagggtgggtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctacctgctaatgttcatttctgcttgttatttcagaatttgactttttaattatggaagcttcattatcattaatacttctattatttcttgattattataagaggagactcaacctttctctaaatttagaaaccaatttggtacaccatgtttactgcaaaccaatcatccaaacaatttcattttgcaaattagcccttaagaataaattagaaattagaaatagcatttcaagcatgggaatatctgttttggtttggaaatatatatatttgtgtgattgtttagaagaaatatttaaaatttcataatatttggaatgctgtcaaaaattccaaattatctattaaatatttagatgattttatagaaaaggagcatttaaaataaaactcaaacataaatatttgactatttctaaaaaataatttttcaagcagaataacaagttagtgttgttgaaagttgccattgttacagttaagattaccccactcctttttctgtctattgcagctccctgacatttcccacctacctcccaggggttgcagcctctgtgcaattactggaataatgtaaaaaaaaaaaagcccaatccaactagtggaatctttgactttatgattgtccccaacatcatggaaataaaaaatacaagtacagtcccgttagaataaatcttc

SEQ ID NO: 120823 - DNA, 1160 bp, Homo sapiens
  Payload ID: 3669
  Gene Symbol: CCDC148
  Gene Name: coiled-coil domain containing 148
  Uniprot ID: Q8NFR7
  ENST ID: ENST00000409889
  CDS Start-End: 264-1031
gagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacaggtgataagataaaactgagtcctgtgtagacttttgacactaactttttatttttgtttgggatcactatacttccaacttactgtatagttactatgtaactggaatacaatcaataaatgtttagactgac

SEQ ID NO: 120824 - DNA, 2523 bp, Homo sapiens
  Payload ID: 3669
  Gene Symbol: CCDC148
  Gene Name: coiled-coil domain containing 148
  ENST ID: ENST00000409187
  CDS Start-End: 152-1954
tatgtgactgttgggaagtaggagatcaagaatcactttttccatgtgggtatccaacagaaccaggaccatttattaaagactgttctttccatactgcacagcagtatgactcacttcttcataaatcaggtgatcatatacggaaaacatgaatcaaagagaccaaccattcatgacaattcagagaaatgatagctcagataatctggtattccatatgaaaaatgagatgagaaacatcaagtacaaaccagtagactatcaacaattgcgtgcattaactgaagcaaagaaattggcttctgcctctgcaaagctaaagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctacctgctaatgttcatttctgcttgttatttcagaatttgactttttaattatggaagcttcattatcattaatacttctattatttcttgattattataagaggagactcaacctttctctaaatttagaaaccaatttggtacaccatgtttactgcaaaccaatcatccaaacaatttcattttgcaaattagcccttaagaataaattagaaattagaaa

SEQ ID NO: 120825 - DNA, 2075 bp, Homo sapiens
  Payload ID: 3669
  Gene Symbol: CCDC148
  Gene Name: coiled-coil domain containing 148
  ENST ID: ENST00000454257
  CDS Start-End: 161-325
actgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctacctgctaatgttcatttctgcttgttatttcagaatttgactttttaattatggaagcttcattatcattaatacttctattatttcttgattattataagaggagactcaacctttctctaaatttagaaaccaatttggtacaccatgtttactgcaaaccaatcatccaaacaatttcattttgcaaattagcccttaagaataaattagaaattagaaatagcatttcaagcatgggaatatctgttttggtttggaaatatatatatttgtgtgattgtttagaagaaatatttaaaatttcataatatttggaatgctgtcaaaaattccaaattatctattaaatatttagatgattttatagaaaaggagcatttaaaataaaactcaaacataaatatttg

SEQ ID NO: 120826 - DNA, 1447 bp, Homo sapiens
  Payload ID: 3669
  Gene Symbol: CCDC148
  Gene Name: coiled-coil domain containing 148
  ENST ID: ENST00000417066
  CDS Start-End: 315-362
atagagaccgatgctgttcagcgcgagagggcctggagagggtgggtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaagtctcaggtatgtctttatcagcagcatgaaaatggactaatacagtaaattggtaccagtagagtgaagtgttgctgaaaagatacccgaaaatgtggaagtgactttggaactggtatcaggcagaggttggaacagtgtggaaggctcagaagaagacgggaaaatgtgggaaagtttggaacctcctagagactttttgaatggttttgacaaaaatgctgatagtgatatgaacaatgaggtcca

SEQ ID NO: 120827 - DNA, 1471 bp, Homo sapiens
  Payload ID: 3669
  Gene Symbol: CCDC148
  Gene Name: coiled-coil domain containing 148
  ENST ID: ENST00000451554
  CDS Start-End: 270-392
gtgtgagagagaaggtgtctcaggtctcgggcgcgggagggggtggcggagaggacagggagattccccagcgctggctctgaaatctggggcaggctttccttgccttactgccaatcccaactgtgcctggtagggtttgtccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagatcagaaaagcaatgttgacttcaaagttatccaaagaacaaacactaataaaacaacacaagcaagtgtggtggcaggaataccagaggctgaatgaagtcagatgtaaaatggaatctgaaataaaatcccttctcaatgaagagaacattggaaatgaatgtctttgtgaccttacaaattttgagcaagagctatcagaacaacagtgcacatatcttaaaaatgtaataaatcctattcagcagctgagagcagatctaaaatacagacagcatcacactttgcagcattcacacccacatattgagtttaactccatgaaagtattggaagaggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaagtctcaggtatgtctttatcagcagcatgaaaatggactaatacagtaaattggtaccagtagagtgaagtgttgctgaaaagatacccgaaaatgtggaagtgactttggaactggtatcaggcagaggttggaacagtgtggaaggctcagaagaagacgggaaaatgtgggaaagtttggaacctcctagagactttttgaatggttttgac

SEQ ID NO: 120828 - DNA, 1786 bp, Homo sapiens
  Payload ID: 3669
  Gene Symbol: CCDC148
  Gene Name: coiled-coil domain containing 148
  ENST ID: ENST00000448656
  CDS Start-End: 128-280
tccctggcgtcaaaggtaggaacagctgagcccttagatgtacccctgacggcgagagcccaggagtgggcgtttcacttttcctgcgtttggggagtccctgaggctatgccctttgacctttgacatgtgtgcagcttctgcttctccagataatctggtattccatatgaaaaatgagatgagaaacatcaagtacaaaccagtagactatcaacaattgcgtgcattaactgaagcaaagaaattggcttctgcctctgcaaagctaaagatgtaaaatggaatctgaaataaaatcccttctcaatgaagagaacattggaaatgaatgtctttgtgaccttacaaattttggttgactttgtgaagaaacaattgaaaactgtctttgaaagacttaggctggagcaacagagaatagaaaatgatctttcagactggagtataaagattctagatcattctttggaagaaaagactaacccgcttagtgaactgcccattgaattagaaagtttggaatgcccataccctgatttgaaatcttcaattctcagtgagttctataagtttacacagaaatatcagaagaagcttcaagactttaatctgcagttggaagacatatacagaaactgtcaactaagtgaagaagaccactggatttaccaggctattttggatcagtaccctggagatctctttggaagaaggactctgtatctggacatgttacaaagatattttcctcacaaatctaggcatgatttggttgaacacgagaaatattgtgaccaatatcgctttgctatagagcagcaaaatatcctgatatcaaattggaataaaaataagaaagactttatacagaaggctgtgctgacactcactgaggcttgtgcaacacatgaaatggagagcatgttggctaaggacaagaaaaagcaacaggaattgtgtgctgatctgaaagccaaggttcgtcaatggcgagcccaccaagaagaggtagcaagactggaaatggaaatttctgccagaagaagagaaaaggaagaggagaaagagaaactgtggaagaagaaggaattgttgcaaagagcagagaagaaaaaaaaaataaaaaaatactgggccaagaaaaaacagaagtggcaagaaatggaaatgagagatcttcagcgtctagaagaactgaagaaattaatcgctgaacagtcactaaaagacagagaaagggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttc

SEQ ID NO: 120829 - DNA, 2127 bp, Homo sapiens
  Payload ID: 3670
  Gene Symbol: CCDC149
  Gene Name: coiled-coil domain containing 149
  Uniprot ID: Q6ZUS6
  ENST ID: ENST00000389609
  CDS Start-End: 145-1734
aaaatgctacgcttaaattttcctggagtccagatgtccttctgaatccactaaaccttgtgaagcgatgtgaacgtcagtcagcactacttattcataagtagtggatagttgccacgtcattaactcatcatcatcaccatcatggtcgtcatcgtcgtcgtcatcatcatcatcatcgccagagcggccacttgggattctgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatgg

SEQ ID NO: 120830 - DNA, 3869 bp, Homo sapiens
  Payload ID: 3670
  Gene Symbol: CCDC149
  Gene Name: coiled-coil domain containing 149
  Uniprot ID: Q6ZUS6
  ENST ID: ENST00000504487
  CDS Start-End: 8-1597
ccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacagccccggttgaggcctgtgtgctgagtgccagagctggagttttctagcttgtaaatctggagaattaactgatctgaagtgactgggaggggtgagcataaaagccggggaacaggactcccagtggtggtctggttttttttgtgagatgagatgagagctaccacctggaaatgctcattctctgcattcagcctgtctcacatacaggattgtatggccatttcaggtttgggaaagatctacctgctgggagccagtctagtttcctgcaccacctggaacttccaaacccttcactccttcaacagaatgttgaggctgcctcatttgtgccaccaagtacgggaatcttaaagacagaaacagagctcatgaccttttatgggaaagagagaggaaaacaaaacaacttcacaacagcatggcaaggggggatgtggaaccaaggacatgatacagggatgggaaaggagggcatgctcaattctagctggttctttcctttcagataaaaatgagcttttctagttggcatccggcactgcagaaaactaaaagtcatccagccatagctttttccttccctggaaagcctgagactagatcccaaagctcagaatgcctctgagaaccagaatcactcctttgagaggcgctccttgcaggaaaaagagaggctcccagagtggtagcctctcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccaccaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccgaaggaaaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcagtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaatta

SEQ ID NO: 120831 - DNA, 1079 bp, Homo sapiens
  Payload ID: 3670
  Gene Symbol: CCDC149
  Gene Name: coiled-coil domain containing 149
  Uniprot ID: Q6ZUS6
  ENST ID: ENST00000502801
  CDS Start-End: 76-501
ggggcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaaggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagc

SEQ ID NO: 120832 - DNA, 2362 bp, Homo sapiens
  Payload ID: 3670
  Gene Symbol: CCDC149
  Gene Name: coiled-coil domain containing 149
  ENST ID: ENST00000635206
  CDS Start-End: 16-1638
gaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccaggcctgagctacaatgtttcagtaggatttgggaggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcactgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacagccccggttgaggcctgtgtgctgagtgccagagctggagttttctagcttgtaaatctggagaattaactgatctgaagtgactgggagggg

SEQ ID NO: 120833 - DNA, 3893 bp, Homo sapiens
  Payload ID: 3671
  Gene Symbol: CCDC15
  Gene Name: coiled-coil domain containing 15
  Uniprot ID: Q0P6D6
  ENST ID: ENST00000344762
  CDS Start-End: 260-3115
ataaggctacggatgggcgggacggagcagcccaccgcaaagtggcggtctacttgaggcggttaccttagtactccgagtagactgagtctgtggcgagctgcgggccgattcctggccagtgccatctcagccggagcaggcctcggggcctcagaagcaggcttttatctggcccgaggctcccagccgttcagcgcgtcttcccataacctataccgattattgggactctcggctgcagacacaggagtcacagatgctgggaagtatggcccgaaagaaacctcgaaatacctcaaggttgcccctggctttaaaccccctgaagagcaaggacgtgttggcagtgctggctgagaggaacgaggctatagtaccagttggggcatgggtggaacctgcctcaccaggtagttcggaaatcccagcatatacatcagcatatttaattgaagaagaactaaaggaacagctaagaaaaaaacaagaagctttgaaacattttcagaaacaagttaaataccgagtaaatcaacaaattaggttgagaaaaaagcaacagcttcagaagtcttatgaaagagcacaaaaagaaggctccatagccatgcagtcttcagcaacacacttaacttccaaaaggacaagtgtttttccaaacaatttgaatgttgctattggaagttctaggttacctccttccctgatgcctggggatggaatagaggatgaagagaatcagaacgaattattccaacaacaagcccaggctcttagtgaaactatgaaacaggcacgtcaccggctagcatcctttaaaaccgtgattaaaaaaaagggatcagtgtttccagatgatggaaggaaaagctttcttaccagagaggaagtgctttccaggaaaccagcatccactgggataaatacaggaataagaggagagttgcccattaaggtccatcaaggtcttttagctgctgtaccttaccagaattatatggaaaatcaggaacttgactatgaggaacctgactatgaggaatcttcatctcttgtaactgatgagaaagggaaagaagatttgtttgggagaggccagcaggaccagcaggctatccattctgaagataagaacaaacctttcagcagagttcagaaagtaaaattcaaaaatccattatttgttctgatggaagaggaagaacaaaagcagttacattttgagggccttcaggatattctgccagaagcccaggattattttctagaagcccaaggtgatttgctggaaacccagggtgatttgacaggaatccagagtgttaagccagatacccaggctgttgaaatgaaggttcaggttactgagccagaaggccaggccattgagccagaaggccagcctattaagacagaaactcagggtattatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcctacccagagaccagcatgttctccacaaagaccaagatattctgccaaaatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaaggccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcagaaagtacactttaaggagccatactctgatatgacagatgagaaagggagagaagacttttctctggcagactatcagtgtttgcctcccaaatcccaggaccaggatgacatcaaaaatcagcaacctgcatcttttatgagagaagaaagagtgagagaagaattgcctctggactatcatcaatatgttgtacctaaaatccaggaccaagactcccctagagaacagaacaagcatatcaaactaccctcatcttttgagaaatgggagattgcaagaggaaatactcctggagtgcccttggcttatgataggtatcaatcaggattgagcactgaattccaagctccactggcatttcagtctgacgtggataaagaagaagataagaaagagcgtcaaaagcagtacctgagacatagacgacttttcatggatattgagagagaacaagttaaagaacaacaaaggcaaaaagaacaaaagaagaaaattgaaaaaattaagaaaaagagagagcaagaatgttatgctgcagagcagaggatcctaagaatgaactttcatgaagatccatattcaggagagaagttgagtgagatattagcccagttacaacttcaagaaataaaaggaaccagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctgggaagaaatactgtctcatataataattagattgtaatcattgttttaatctctgtctgggaaccaagattgaaagctgacttacttctctcttctgtcttgtgaaccatacggagcctattattttaaaatatgatcagacaagtaaggcttctcttactttgctctgctctgatcagaagagctcatgtgaagtctttgagattctcttatttatcatctttctaaaactgtgtttttgagcttgacagtactgaaaatgtctggatgaagcagaaaagaaagtgatgaaatgtgtttctgagcatcagagaccatctatattgccattaccttttctagttgtatataagaattcaagattagaagaatttagatttgttgcacatttttttcctcagcattttttcctcttgttttttaaaatgtattgcctctttccccattcagtgacactggacataggaatttttaattgtgtaattttctgttgcaaaaagggtaaataaatcctttgtcttttgaatatcttctatgtgaaataattgtgagtgacatttgaaaaagtgaatctgaagtcaaagtgagtaaattccttatttccctattttttaaaaacctggtatatgacatggctacagggcaaatgaaataaaaattgccatagttggtatgaa

SEQ ID NO: 120834 - DNA, 3924 bp, Homo sapiens
  Payload ID: 3671
  Gene Symbol: CCDC15
  Gene Name: coiled-coil domain containing 15
  ENST ID: ENST00000529051
  CDS Start-End: 260-3148
ataaggctacggatgggcgggacggagcagcccaccgcaaagtggcggtctacttgaggcggttaccttagtactccgagtagactgagtctgtggcgagctgcgggccgattcctggccagtgccatctcagccggagcaggcctcggggcctcagaagcaggcttttatctggcccgaggctcccagccgttcagcgcgtcttcccataacctataccgattattgggactctcggctgcagacacaggagtcacagatgctgggaagtatggcccgaaagaaacctcgaaatacctcaaggttgcccctggctttaaaccccctgaagagcaaggacgtgttggcagtgctggctgagaggaacgaggctatagtaccagttggggcatgggtggaacctgcctcaccaggtagttcggaaatcccagcatatacatcagcatatttaattgaagaagaactaaaggaacagctaagaaaaaaacaagaagctttgaaacattttcagaaacaagttaaataccgagtaaatcaacaaattaggttgagaaaaaagcaacagcttcagaagtcttatgaaagagcacaaaaagaaggctccatagccatgcagtcttcagcaacacacttaacttccaaaaggacaagtgtttttccaaacaatttgaatgttgctattggaagttctaggttacctccttccctgatgcctggggatggaatagaggatgaagagaatcagaacgaattattccaacaacaagcccaggctcttagtgaaactatgaaacaggcacgtcaccggctagcatcctttaaaaccgtgattaaaaaaaagggatcagtgtttccagatgatggaaggaaaagctttcttaccagagaggaagtgctttccaggaaaccagcatccactgggataaatacaggaataagaggagagttgcccattaaggtccatcaaggtcttttagctgctgtaccttaccagaattatatggaaaatcaggaacttgactatgaggaacctgactatgaggaatcttcatctcttgtaactgatgagaaagggaaagaagatttgtttgggagaggccagcaggaccagcaggctatccattctgaagataagaacaaacctttcagcagagttcagaaagtaaaattcaaaaatccattatttgttctgatggaagaggaagaacaaaagcagttacattttgagggccttcaggatattctgccagaagcccaggattattttctagaagcccaaggtgatttgctggaaacccagggtgatttgacaggaatccagagtgttaagccagatacccaggctgttgaaatgaaggttcaggttactgagccagaaggccaggccattgagccagaaggccagcctattaagacagaaactcagggtattatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcctacccagagaccagcatgttctccacaaagaccaagatattctgccaaaatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaaggccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcagaaagtacactttaaggagccatactctgatatgacagatgagaaagggagagaagacttttctctggcagactatcagtgtttgcctcccaaatcccaggaccaggatgacatcaaaaatcagcaacctgcatcttttatgagagaagaaagagtgagagaagaattgcctctggactatcatcaatatgttgtacctaaaatccaggaccaagactcccctagagaacagaacaagcatatcaaactaccctcatcttttgagaaatgggagattgcaagaggaaatactcctggagtgcccttggcttatgataggtatcaatcaggattgagcactgaattccaagctccactggcatttcagtctgacgtggataaagaagaagataagaaagagcgtcaaaagcagtacctgagacatagacgacttttcatggatattgagagagaacaagttaaagaacaacaaaggcaaaaagaacaaaagaagaaaattgaaaaaattaagaaaaagagagagcaagaatgttatgctgcagagcagaggatcctaagaatgaactttcatgaagatccatattcaggagagaagttgagtgagatattagcccagttacaacttcaagaaataaaaggaaccagagaaaaacaacagagagaaaaagaatacctgagttcactttgcctgattatactttatttgtacagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctgggaagaaatactgtctcatataataattagattgtaatcattgttttaatctctgtctgggaaccaagattgaaagctgacttacttctctcttctgtcttgtgaaccatacggagcctattattttaaaatatgatcagacaagtaaggcttctcttactttgctctgctctgatcagaagagctcatgtgaagtctttgagattctcttatttatcatctttctaaaactgtgtttttgagcttgacagtactgaaaatgtctggatgaagcagaaaagaaagtgatgaaatgtgtttctgagcatcagagaccatctatattgccattaccttttctagttgtatataagaattcaagattagaagaatttagatttgttgcacatttttttcctcagcattttttcctcttgttttttaaaatgtattgcctctttccccattcagtgacactggacataggaatttttaattgtgtaattttctgttgcaaaaagggtaaataaatcctttgtcttttgaatatcttctatgtgaaataattgtgagtgacatttgaaaaagtgaatctgaagtcaaagtgagtaaattccttatttccctattttttaaaaacctggtatatgacatggctacagggcaaatgaaataaaaattgccatagttggtatg

SEQ ID NO: 120835 - DNA, 3685 bp, Homo sapiens
  Payload ID: 3672
  Gene Symbol: CCDC150
  Gene Name: coiled-coil domain containing 150
  Uniprot ID: Q8NCX0
  ENST ID: ENST00000389175
  CDS Start-End: 136-3441
agttcccgacatgccctgccacgggtgcgcctgcgtaccggagctactgcgccggggagcgggttggtttaaaatgctgtgttagttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaggctatttggaagctccagactgtttagaagacctggacagccagaaagtcattagtcctatccaaaatgaagcaatttgtgcaggaaaaacagatattttatggaagaactgtgagtttctggtaaatcgaatgtgccgtcttgaaagcctcatgcagtccttgaagatgaacatctttcggctgcaaactgaaaaggatttgaatcctcagaaaacagcttttctgaaagatcgactgaatgcaatacaggaagagcattctaaggacctgaagctgttgcatctcgaagttatgaatttgcgccagcaactgagagctgtaaaagaggaagaagacaaggcacaagatgaggtgcaaaggttgactgccactctgaagattgcctcgcagacaaagaagaatgcagccattattgaagaggaactgaagaccacaaaacgtaaaatgaaccttaaaattcaagagctaaggagacaactggctcaggagaagtaccttagggaatctttagagaaatcagcatcagccatgctcctcaaaatacaagaaatgggatcaacagtggaggtagaacgaaaacaggtgcacattttgcagcaaaactgcattgctctacgtgattctatacagagcgctcaagaactactggcccaggaacaaaaaaaaaaagaagagttggagattgctacttcacagctcaaatctgatctaacttctagagatgacctcatttccaagttggttgaagaaaataagaacctgcagatatctttcaacaaggaacatgaagaaaatgcatatttgaggtccgaaataatgtctcttcatgaagcatcagaaaaagcacaagttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggaggttaataaaacagaaaaagaaatagtgcaagaaagatgcaatttggaaaaggaattagctaaaaacaaggtagacataaatacattaactcataacctgcagactcttgaagaagagaataagcacctggcagatcaaatggcttccctagaacttcagcaagtcacttctgattaccatgggcttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggcaaactcagaactcagtgccaagagggtacacctgcagcaggcagatgctcacctgaaagaagtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgataggagatgg

SEQ ID NO: 120836 - DNA, 2243 bp, Homo sapiens
  Payload ID: 3672
  Gene Symbol: CCDC150
  Gene Name: coiled-coil domain containing 150
  ENST ID: ENST00000409270
  CDS Start-End: 241-2007
ttaaaggaggcctcattagatgcgctctctgacagggaagttggcataaggtctgtttctttgctgggtcatattttacagtgtgatctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgata

SEQ ID NO: 120837 - DNA, 3047 bp, Homo sapiens
  Payload ID: 3672
  Gene Symbol: CCDC150
  Gene Name: coiled-coil domain containing 150
  ENST ID: ENST00000431807
  CDS Start-End: 214-420
acgcattccctgagcgccgccggatgccggcctgggtcccgcccagggctgagggccctcctgggccgggaaaactacagttcccgacatgccctgccacgggtgcgcctgcgtaccggagctactgcgccggggagcgggttggtttaaaatgctgtgttagttccacggaaacccgctcgcctgctgcagtacggagcctcaggcggacagatggactgtaaggtacatatggaaactacagtgtccagaccggtcctttctccaacccacatcaacgctacagcttctgaaacattcacagtacttcagcaaaggatgagaatagttgaggaacagaccagttcactgagggatgacctaataatgttggattttggtgaaaaaagaagaatgcagccattattgaagaggaactgaagaccacaaaacgtaaaatgaaccttaaaattcaagagcttctagagatgacctcatttccaagttggttgaagaaaataagaacctgcagatatctttcaacaaggaacatgaagaaaatgcatatttgaggtccgaaataatgtctcttcatgaagcatcagaaaaagcacaagttttgaatgaccaattgactaaaaagtgttcagagttgagctgcatgcttcagactgttactatggaaaaagccagaatcattgctgaccatcaggccattctgcaggtagagcagaaaatgatgacgcagacatttcaagaacaaaacttattgctggatgcagcccatgccagtatcacaaatgaactacagactgttcagaatgagaaaacccaactccaggcacatctggatcatttaatccttgagcataaccagtgtatccagaaagcacaggatgctgaaaagagaacagctgtgcaaaaagagctgctagaatcaactattgcaagattgcgaggtgaattggaagcatcaatgcaagagaagaagtctctgctagaggagaaagaaagatttcagagggaggttaataaaacagaaaaagaaatagtgcaagaaagatgcaatttggaaaaggaattagctaaaaacaaggtagacataaatacattaactcataacctgcagactcttgaagaagagaataagcacctggcagatcaaatggcttccctagaacttcagcaagtcacttctgattaccatgggcttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgtatgatagg

SEQ ID NO: 120838 - DNA, 2639 bp, Homo sapiens
  Payload ID: 3672
  Gene Symbol: CCDC150
  Gene Name: coiled-coil domain containing 150
  ENST ID: ENST00000424427
  CDS Start-End: 259-807
gatgaggtcacagagttgttaaaggaggcctcattagatgcgctctctgacagggaagttggcataaggtctgtttctttgctgggtcatattttacagtgtgatctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagttaaagaataaatggtctgagtttaatagggcatattgcctctatgttatgagagaacaaggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctagcagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgt

SEQ ID NO: 120839 - DNA, 2614 bp, Homo sapiens
  Payload ID: 3672
  Gene Symbol: CCDC150
  Gene Name: coiled-coil domain containing 150
  Uniprot ID: Q8NCX0
  ENST ID: ENST00000448409
  CDS Start-End: 212-1465
tgacagggaagttggcataaggtctgtttctttgctgggtcatattttacagtgtgatctcttcactctgaaagcagagaaacacattttcaatatattttccattacggctccttctagaacactgtgttgtttctcctagtaaaggggctattccttgaaaaataactctaggtttagctgattttattgtttttattaataattgacgatgcctctaagaaaaaggaaatccccagagaggactgcatcttcaaaatcccccgaaatctctaggtcccatgtaaacagtataaaggaaagaacgtcatcagttggtttgcctagtgttattccaaactctacacgccgtgtgagctttgcacctaacctgccttctatgaaaacatctcaggatattggagactctaggatctctctaaagactcttttgaatgctattaaaaccatggagggaagactggaaggcaaaatagagattctagcctcaagacctttaataaatgatgaatcaccaaattttcttaaacaggactcggtgaaatctattcttgaaagaagtaaagaggagctgtcccgaacagtgaagtgtcgtaatgcggccctgaaagagagtcagaagttgaaagaagacctcgaggctgtggaggacagggaaaacaagaaggtgggaaactttcagcgacaattggcagaagctaaagaagacaactgcaaagtcacaatcatgttggagaatgtgctggcttctcacagtaagatgcaaggtgctctggagaaagtacaaatagagcttgggcggagggattcagagattgcaggcctcaagaaagaaagggatctcaatcaacagagggtgcagaagctggaagctgaagtggaccagtggcaggccaggatgcttgtcatggaggaccagcacaacagtgagattgaatctctacaaaaagctctaggtgtagctagagaagacaacaggaaacttgctatgagtctggaacaagctctccagacaaataatcatctgcaaacaaagctagatcacattcaagagcaattggaaagcaaagaacttgagcgacagaatttggaaaccttcaaagaccggatgactgaagagtccaaagtggaagcagaattgcatgctgaacgcatagaagctctaagaaagcagtttcaaaccgagagagaaactacaaagaaagtggcacaacgggaagtggctgagctgaagaaagcccttgatgaagctaacttcagatcagtggaagtgtcccggaccaaccgagagctgcgacagaaacttgcagagctagaaaaaatactagaaagtaacaaggagaaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctagcagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggaattggaagaaactgtcagacacctgaagaaatgtaaagaggcaacagagaatacgctgaaagaagccagtgtggaatcagaacagataacagctaatctggaagaagctcatcgctggtttaagcacaggtttgatggtctacaacttgagctgacaaaaaaccggttgcagaggccttctggggaagacaggtggcaggaaaaggaccaagatgtaaaacatgatgtcatgtccaaccaatctgttctgcatcgatgggagagaaaacagaatcttaggcccatgcccaagaagtatcattctgaggtacagaggaagtgatgtccttgacaagggagcttctttatgtgtagctacactccatgattccaagagcccagcagccggggctggcctgtttctagagtcataagaacatgaagtctttgatgtgggctgaagattttggacctgagtttatcactttatgaactcttatatcagtacaaaactacccctttttttgtcccttttcacattttccacccaataaatttgtgttaatttgttgta

SEQ ID NO: 120840 - DNA, 2107 bp, Homo sapiens
  Payload ID: 3673
  Gene Symbol: CCDC151
  Gene Name: coiled-coil domain containing 151
  Uniprot ID: A5D8V7
  ENST ID: ENST00000356392
  CDS Start-End: 89-1876
aggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatgc

SEQ ID NO: 120841 - DNA, 1943 bp, Homo sapiens
  Payload ID: 3673
  Gene Symbol: CCDC151
  Gene Name: coiled-coil domain containing 151
  ENST ID: ENST00000591179
  CDS Start-End: 106-1713
gcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagagggtgaccggaaggctttttttgagagctctcagtggaacatcaagaagaaccaggagaccatcagtcagctccgcaaggagactaaggcactggaactaaagctgctggacctgctcaaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaaggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 120842 - DNA, 2448 bp, Homo sapiens
  Payload ID: 3673
  Gene Symbol: CCDC151
  Gene Name: coiled-coil domain containing 151
  ENST ID: ENST00000591345
  CDS Start-End: 163-510
aggcggttacctggcaaccgagagatgcggagcgcaaccacctagcggtcggaaagtgcatttttcagagccctaggaatccgagctgacggatccctgacaggggcgactgactcctagttatccccctaacccctaggggccttcagccccaaccccatcatgacatctcctctgtgcagggcggcctccgccaacgccctgcctcctcaggaccaggcttcgacgccctcttccagggtcaagggcagggaggcttcgggcaaacccagccacctccgaggcaagggcacagcccaggcgtggaccccaggccgttccaagggaggatccttccacagaggtgcagggaagccctctgtgcactctcaggtggctgagttacataaaaagatacaactgttagaatctcactctgttgccaggtgggagtgcagtggaacgatttcggctcactgcaacctccgcctcccggaatctcttgaacccgggaggcggaggctgtggtgagccgagattgcaccattgcactgcagcctgggcaacaagagtgaaactccatctcaaaaaaaaaaaaaaagttgatgattgcaaaaaaggtctttcctctgggatgttgcacccatgcacccacccagtaactgtgtgtctgtccacctcacctgcctgccagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatgc

SEQ ID NO: 120843 - DNA, 1867 bp, Homo sapiens
  Payload ID: 3673
  Gene Symbol: CCDC151
  Gene Name: coiled-coil domain containing 151
  ENST ID: ENST00000586836
  CDS Start-End: 423-1637
cacacccacacatgcaccctccggttgccccctgtaagaaactgaggtgccctcccacccgctcgttcacacctacacgaggccggagcaaagagggtgaccggaaggctttttttgagagctctcagtggaacatcaagaagaaccaggagaccatcagtcagctccgcaaggagactaaggcactggaactaaagctgctggacctgctcaagggagatgagaaagtggtccaggcagtgattcgcgaatggaagtgggagaagccatacctgaagaacaggacaggacaggccctggagcacctagaccaccggctgagggagaaggtgaagcagcagaacgccctgcggcaccaggtggtgttgcggcagaggcggctggaggagctccagctgcagcacagcctgcgccttctggagatggcggaggcgcaaaacagacacacggaggtggccaagaccatgcggaacctggagaaccgcctggagaaggcccagatgaaggcgcaggaggccgagcacattaccagcgtgtacctgcagctcaaggcctatctaatggacgagagcctcaacttggagaaccggctggactccatggaggctgaggtggtgaggaccaaacatgagctggaggcactgcacgtggtgaaccaagaggccctcaatgcccgggacattgccaagaaccagctgcagtacctagaggagaccttggttcgagagcgcaagaagcgggaacgctacataagtgagtgcaagaagcgcgccgaggagaagaaactggagaacgagcgcatggagcgcaagacccaccgcgagcacctgctgctacagtccgacgacaccatccaggacagcctgcatgccaaggaggaggagctgcggcagcgctggagcatgtaccagatggaggtgatctttggcaaggtcaaggacgccactggcactgacgagacgcactcgttggtgcggcggttcctggcccagggcgacaccttcgcgcagttggagacgctcaagagcgagaacgagcagacgttggtgaggctgaagcaggagaagcaacaactgcagcgggagctggaagacctcaagtactcgggggaggccacgctggtgagccagcagaaactgcaagccgaggcgcaggagcgtctcaagaaggaggagcggcggcacgccgaggccaaggaccagctggagcgcgccttgcgggcgatgcaagtggccaaggacagcctggagcacctggccagcaagctgatccacatcactgtggaggacggccgcttcgcgggaaaggagctggatccccaggcagataactatgtgccaaacctgctgggcctcgtggaggaaaagctgctgaaactgcaggcgcagctccagggccacgacgtgcaggagatgctgtgccacatcgctaaccgcgagttcctcgccagcttagagggaaggctgcccgaatacaacacccgcatcgccctgccccttgccacttccaaggacaagttttttgacgaagagagtgaggaggaggacaacgaggtagtgacccgcgcatcactcaagatccgttcccagaaattaatcgaaagtcacaagaagcaccgtcgctctcggaggtcctagactcgtcctgacacccaccaggcggcccccttcggagcccccgatccctccgggtctagcgcaggccccacggggccccttcaggggctgaacgcggcccggaccgggaacggaggcggccagcggcgcccggaggggaggaaggggccgggccagacgttcccacagtaaatctccccagctgggtccgccccggcctcagagttgcgcaataaatgttaccgaccatg

SEQ ID NO: 120844 - DNA, 3431 bp, Homo sapiens
  Payload ID: 3674
  Gene Symbol: CCDC152
  Gene Name: coiled-coil domain containing 152
  Uniprot ID: Q4G0S7
  ENST ID: ENST00000361970
  CDS Start-End: 88-852
ccggaggaggggacagcattcaggggtgtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggaatataagaataatattgccaaacttgtaagtgaaatgaaaatcaaagaggagggatataagaaagaaataagcaaactttatcaggacatgcagagaaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtcagctttaaggtttttattgaatttatttggacaaatccgtactgtatccaattctgtactgcattcttgcttaatagtattaaccataaaggaggtcaggtttatagggtttggtttacctattaaaccatcattgactatggaaatacttactaagcaatatagagacagacaatattatctttccccttatatcttttaagacagccactcaagttttagaagagtatgatacaacattagagaaagaaagatacaaaggctttattcatgtgtgatagtaaaaatcaggatgagtcttagatatacaaaagataaatggatatttaaaatagttatatatgcttttttagcaaaatattcacgtgttaagtatttctggatcttaaaatacaaaatccacttattttattagttaaaagtagaagattgaaaagacaaagtaatattgttttgagagataagtaaagaaaaaaatggaaagcatgtctttgttgttcttcctccattctaaactgctaattatccaacagaaacccctaggtcatagtttacgtttctattctcattaaagcaaatagaacactggaaaaagaaaaaaaaagacatattaaccaaaagctgcaatcacctttcagttgctccatcataaaaaatatggtttgagtcaatatttctatgacataaaatttaaaatctggaagccaattcagtagatttctccatgtttgcacaaatctaatttctatttttggttcactaatttggtagtttataaaaatgctggaaatgaaattgtgtctagactaaattggggagtatgtcctattttaaatatttagtttgaaggtcattctcacttttttgcctgattctttcagcgtcaactggcactggcttctgtgggtataagctgctgacttatttgtcaggcagctggaggcaaacgtcactgacaagattcagttatgttctcctctgcccgaagtccctgtcagctacataaagatgggaggttttctttacactgtcaggtgattgcagaccctgttttttcaaatatcagatgtcgacaatggcagcatcagctcctaggagccaactctgaatctgtgggcaatttacagagtaattgatttatacatctctttcgacagagcttcttttgtaaatcttgtaaatcttcacttgctggcatatctcggttctctgggtgaccctgcctatgctgacccttgtgcttatggtggtgatgaaggcctggaggagcaggatgagtaggagcatttggtgctcctggttgctgattctctgaaagctcactgctgccaaggtgctgatgtccatgattgtgatgatgctcatgatggtaatgaggcgatggagtttcaactgttttatccacagtagccaaagatacacgtttacaaaagtcttcatctttgagagtctggaacaaatttataaatcactttttaacaagcttatagagataggaataatgcgtgaaaaatgatttgtagagctaacatgtgaaattccaactagttaattagaatcgagctggctttgtattatattaatgagaaagagtctgatgttagtctcaacacctagacattttattaaaggcttaaaaagaaagccaaaccactgtacttatatttgcagaagcaaatgaagtaaactggcaaaaggaacttggattgcaggaaagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaagatggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgttagtttttcatacttcatcctatgccaggaaatgttttgaacttcaccaaagctttgctaatgtctccctaccataaggctgtcagctgaaaatagcaaattactgcccgactcccattgaccataatatccattccgcatgatcctagttctttaatttactggaagtctttactgttttgtggtacctactaatcagagactcaaagcctatagatacagaaatgtaacagtaaatctcaacctaaggctaatttgcaaataaaattacaaaatcaacttagaacccaaa

SEQ ID NO: 120845 - DNA, 1237 bp, Homo sapiens
  Payload ID: 3674
  Gene Symbol: CCDC152
  Gene Name: coiled-coil domain containing 152
  Uniprot ID: Q4G0S7
  ENST ID: ENST00000388827
  CDS Start-End: 71-667
attcaggggtgtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtcagctttaaggtttttattgaatttatttggacaaatccgtactgtatccaattctgtactgcattcttgcttaatagtattaaccataaaggaggtcaggtttatagggtttggtttacctattaaaccatcattgactatggaaatacttactaagcaatatagagacagacaatattatctttccccttatatcttttaagacagccactcaagttttagaagagtatgatacaacattagagaaagaaagatacaaaggctttattcatgtgtgatagtaaaaatcaggatgagtcttagatatacaaaagataaatggatatttaaaatagttatatatgcttttttagcaaaatattcacgtgttaagtatttctggatcttaaaatacaaaatccacttattttattagttaaaagtagaagattgaaaagacaaagtaatattgttttgagagataagtaaag

SEQ ID NO: 120846 - DNA, 1295 bp, Homo sapiens
  Payload ID: 3675
  Gene Symbol: CCDC153
  Gene Name: coiled-coil domain containing 153
  Uniprot ID: Q494R4
  ENST ID: ENST00000503566
  CDS Start-End: 1-633
atgccacctaaaaacaaagaaaaagggaagaaatctggggcacagaagaagaaaaagaactggggtgcagatgtggtggccgagtccaggcacaggctggtggtgctggagaaggagctgctccgagaccacttggctctacggagggatgaagcccgtcgagccaaggcttccgaagaccagctgaggcagaggctgcaaggggtggaggctgagctggaaggggcccgaagtgaagggaaggccatatatgcagagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactcaatagagctgtgggctctggccgtttggcagagagaagtggatcttatttttatttttatttttatttagttttcttctttttttgtttttgttgttgtttatttttaggagtggctgtcatacagacatctcagttctgggttgacccattatccctgagattcagtgattgataggaaataaatttgaccaggtctcaacctctctcctgcaggagccgcatcccaccccttgagcctgaggcccttttggtcccttcacaccactgccccttacccccaccaacacaaacacaggcagtcagatttatggcgaatggccatttctataacaaatgcaacggtgaccaagcaccaccctcccgcaatgctaaggcacccacagagggcaggcatagctggtctccaaatttttgcattacactcaagggtcctggagtcatatctagaaaaggtccagatggcttcaatcctagccagacccacagccacaccttcatccttgggacacagctctctaaaactcccatatgacatcctctggagcctcagactccttcagggacctgtctgaggcctccaaccacaccctctgctggcaggtgggcctgcaggaag

SEQ ID NO: 120847 - DNA, 1173 bp, Homo sapiens
  Payload ID: 3675
  Gene Symbol: CCDC153
  Gene Name: coiled-coil domain containing 153
  Uniprot ID: Q494R4
  ENST ID: ENST00000415318
  CDS Start-End: 497-1129
tctaggtcagtaccctagagtccatgggtccactattcctctgcgtctcatttctctgaagtgggaaactccctggactacctattcctgcacttattaccctcattctacagtgtactgaagaggatcttcggtggtctgggagttttgtttgtttgagacagggtctccctctgtcatccaggctggagtgcagtggtgcaatcatagctcactgctgcctcaacctcccaggctcaagtgattctcctgcttcagcctcccaagtagctgagactacagttgcctggacaacatacagcctctggaaacccaaccttccagccctcagtcctgccctcaagagaaatttgccaccaaggattggctcccaggacccaggccccgcctcaggctcctcgctagttgggccttctctctgccactccccacgagtgggtcactccacggggagccccaacgctggcaggagaggatcctacaggacagcaaggagatgccacctaaaaacaaagaaaaagggaagaaatctggggcacagaagaagaaaaagaactggggtgcagatgtggtggccgagtccaggcacaggctggtggtgctggagaaggagctgctccgagaccacttggctctacggagggatgaagcccgtcgagccaaggcttccgaagaccagctgaggcagaggctgcaaggggtggaggctgagctggaaggggcccgaagtgaagggaaggccatatatgcagagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactc

SEQ ID NO: 120848 - DNA, 2212 bp, Homo sapiens
  Payload ID: 3676
  Gene Symbol: CCDC154
  Gene Name: coiled-coil domain containing 154
  Uniprot ID: A6NI56
  ENST ID: ENST00000389176
  CDS Start-End: 168-2192
gaaggcagccagacgagggcagcagctcgtccctcaaggcccagagctctcacgggacttcctctggctcctgacccccctggcctgtgcccagctctgggcaacctcagaggccccaaggcccaagctacagccgagggcagggtggccggtgcagcccagcagccatgtcagagttggctgacagtggaccctcaggggcatcggccccttcccagctgagagccgtcaccctggaagacctggggctcctcctggcaggaggcctggccagccccgagcccttgagcctggaggagctctcggagaggtatgagtccagccatccgacatccacggcctctgtccccgagcaggacaccgccaagcactggaaccagctggagcagtgggtggtggagctgcaggccgaggtggcctgcctgcgggagcacaagcagcgctgtgagcgcgccacgcggagcctgctgcgggagctgctccaggtgcgggcccgcgtgcagctgcagggctcagagctgaggcagttgcagcaggaggcgcggccggcagcccaggcccccgaaaaggaggcgccggagttctctggtctccagaaccagatgcaggccctggacaaaaggctggtggaggtccgggaagccttgacccggctcaggaggaggcaggtgcaacaggaggcggagagaaggggcgccgagcaagaggccggcctcagactggccaagctgaccgacttgctgcagcaggaggagcagggccgggaggtggcctgcggcgccctgcagaagaaccaagaggacagcagccggagggtggacctggaggtggccagaatgcaggcccaggtgaccaagctcggcgaagaggtgagcctgcgcttcctgaagagggaggccaagctgtgcggcttcctgcagaagagcttcctggccctggagaagagaatgaaggcctcggagagctcacggctgaagctggagggcagcctgcggggcgagctggagagccggtgggagaagcttcgggggctgatggaggagcgcctgcgggccctgcaggggcagcatgaggtggggccgggcgggcggcgggcagaggagagccacctcctggagcagtgccagggcctggatgctgccgtggcccagctgaccaagtttgtgcagcagaaccaggcgtcgctgaaccgtgtcctactggccgaggagaaagcctgggacgccaaggggcgcttggaggaaagccgggctggggagctggccgcctatgtgcaggagaacctggaggccgcacagctggctggcgagctggcccggcaggagatgcatggagagctggtgctgctccgagagaagagccgggctctggaggcatccgtggcgcagctggccgggcagttaaaggagctgagtggccatctcccggctctgagcagccggctcgatctgcaggagcagatgctgggcctcaggctgtccgaggcaaagaccgaatgggaaggtgcagagaggaagtccctggaggacctggccaggtggcggaaggaggtgaccgaacacctgcgaggggtgcgggagaaggtggatggcctcccccagcagatagagagtgtctccgacaagtgcctgcttcataagagcgactcagacctcaggatttccgccgaaggcaaggccagggagttcaaggttggggccctgcggcaggagctggccacgctactatcatccgtgcagctgctaaaggaagacaaccctgggcggaagatcgcggagatgcagggcaagctggccacgaaccaaataatgaagctggaaaactgcgtccaggccaacaagaccatccagaacctcaggttcaacactgaggcccggctgcgcacgcaggagatggccaccctgtgggagagtgtgctccggctgtggagtgaggagggcccgcggacgccgctgggcagctggaaggcgctcccatccctggtgaggccgcgggtcttcatcaaggacatggcgcctggcaaggtggtgcccatgaactgctggggcgtgtaccaggctgtgaggtggctgcgctggaaggcgtccctcataaagctcagggccctgcggaggccaggaggggtcctggagaagccccacagccaggagcaggtgcagcagctcacaccctcactgtttatccagaaataaacgtgctggctttgtactca

SEQ ID NO: 120849 - DNA, 2561 bp, Homo sapiens
  Payload ID: 3676
  Gene Symbol: CCDC154
  Gene Name: coiled-coil domain containing 154
  ENST ID: ENST00000409671
  CDS Start-End: 973-2541
tctggggagagaaggaaggttctggaacggccccgctgccccacacctgcctccctggggaccctgagaaggcagccagacgagggcagcagctcgtccctcaaggcccagagctctcacgggacttcctctggctcctgacccccctggcctgtgcccagctctgggcaacctcagaggccccaaggcccaagctacagccgagggcagggtggccggtgcagcccagcagccatgtcaggtgaccagagcggaggagcggggcccagggaggggcttgccacaggtgtgagggtggggaccgctctgcttctgaccccgggctccctccagctcgcttgttcctgccgcccagtgctgtgtgtcttcaggcagggccctggacttgtctgagccaagcccgtctggatcctgtgtgacccaaggagacgcgttgagctctgggtggtgggcgagggtcctgcgggggtttggggccttgttcccgtaagctccagtgggggccgggccccaaggggcaagctcccaagatgcctccttgtagagttggctgacagtggaccctcaggggcatcggccccttcccagctgagagccgtcaccctggaagacctggggctcctcctggcaggaggcctggccagccccgagcccttgagcctggaggagctctcggagaggtatgagtccagccatccgacatccacggcctctgtccccgagcaggacaccgccaagcactggaaccagctggagcagtgggtggtggagctgcaggccgaggtggcctgcctgcgggagcacaagcagcgctgtgagcgcgccacgcggagcctgctgcgggagctgctccaggtgcgggcccgcgtgcagctgcagggctcagagctgaggcagttgcagcaggaggcgcggccggcagcccaggcccccgaaaaggaggcgccggagttctctggtctccagaaccagatgcaggccctggacaaaaggctggtggaggtccgggaagccttgacccggctcaggaggaggcaggtgcaacaggaggcggagagaaggggcgccgagcaagaggccggcctcagactggccaagctgaccgacttgctgcagcaggaggagcagggccgggaggtggcctgcggcgccctgcagaagaaccaagaggacagcagccggagggtggacctggaggtggccagaatgcaggcccaggtgaccaagctcggcgaagaggtgagcctgcgcttcctgaagagggaggccaagctgtgcggcttcctgcagaagagcttcctggccctggagaagagaatgaaggcctcggagagctcacggctgaagctggagggcagcctgcggggcgagctggagagccggtgggagaagcttcgggggctgatggaggagcgcctgcgggccctgcaggggcagcatgaggagagccacctcctggagcagtgccagggcctggatgctgccgtggcccagctgaccaagtttgtgcagcagaaccaggcgtcgctgaaccgtgtcctactggccgaggagaaagcctgggacgccaaggggcgcttggaggaaagccgggctggggagctggccgcctatgtgcaggagaacctggaggccgcacagctggctggcgagctggcccggcaggagatgcatggagagctggtgctgctccgagagaagagccgggctctggaggcatccgtggcgcagctggccgggcagttaaaggagctgagtggccatctcccggctctgagcagccggctcgatctgcaggagcagatgctgggcctcaggctgtccgaggcaaagaccgaatgggaaggtgcagagaggaagtccctggaggacctggccaggtggcggaaggaggtgaccgaacacctgcgaggggtgcgggagaaggtggatggcctcccccagcagatagagagtgtctccgacaagtgcctgcttcataagagcgactcagacctcaggatttccgccgaaggcaaggccagggagttcaaggttggggccctgcggcaggagctggccacgctactatcatccgtgcagctgctaaaggaagacaaccctgggcggaagatcgcggagatgcagggcaagctggccacgtttcagaaccaaataatgaagctggaaaactgcgtccaggccaacaagaccatccagaacctcaggttcaacactgaggcccggctgcgcacgcaggagatggccaccctgtgggagagtgtgctccggctgtggagtgaggagggcccgcggacgccgctgggcagctggaaggcgctcccatccctggtgaggccgcgggtcttcatcaaggacatggcgcctggcaaggtggtgcccatgaactgctggggcgtgtaccaggctgtgaggtggctgcgctggaaggcgtccctcataaagctcagggccctgcggaggccaggaggggtcctggagaagccccacagccaggagcaggtgcagcagctcacaccctcactgtttatccagaaataaacgtgctggctttgtactca

SEQ ID NO: 120850 - DNA, 708 bp, Homo sapiens
  Payload ID: 3676
  Gene Symbol: CCDC154
  Gene Name: coiled-coil domain containing 154
  ENST ID: ENST00000483702
  CDS Start-End: 1-300
cagttaaaggagctgagtggccatctcccggctctgagcagccggctcgatctgcaggagcagatgctgggcctcaggctgtccgaggcaaagaccgaatgggaaggtgcagagaggaagtccctggaggacctggccaggtggcggaaggaggtgaccgaacacctgcgaggggtgcgggagaaggtggatggcctcccccagcagatagagagtgtctccgacaagtgcctgcttcataagagcgactcagacctcaggatttccgccgaaggcaaggccagtttcagaaccaaataatgaagctggaaaactgcgtccaggccaacaagaccatccagaacctcaggttcaacactgaggcccggctgcgcacgcaggagatggccaccctgtgggagagtgtgctccggctgtggagtgaggagggcccgcggacgccgctgggcagctggaaggcgctcccatccctggtgaggccgcgggtcttcatcaaggacatggcgcctggcaaggtggtgcccatgaactgctggggcgtgtaccaggctgtgaggtggctgcgctggaaggcgtccctcataaagctcagggccctgcggaggccaggaggggtcctggagaagccccacagccaggagcaggtgcagcagctcacaccctcactgtttatccagaaataaacgtgctggctttgtactcattaga

SEQ ID NO: 120851 - DNA, 2378 bp, Homo sapiens
  Payload ID: 3677
  Gene Symbol: CCDC155
  Gene Name: coiled-coil domain containing 155
  Uniprot ID: Q8N6L0
  ENST ID: ENST00000447857
  CDS Start-End: 206-1894
ctccttttgctttttctggcgggaaaagctcacgcgcacctcccccaactcaactgccgttcgtcgttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccagagcca

SEQ ID NO: 120852 - DNA, 531 bp, Homo sapiens
  Payload ID: 3677
  Gene Symbol: CCDC155
  Gene Name: coiled-coil domain containing 155
  ENST ID: ENST00000594905
  CDS Start-End: 305-531
tgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaattcaggtgctccagaaggagagactgccctgttggctgggaccccagagcaactcctgactcactgtgggagctcacttactgttgagtgaacggacggattgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtga

SEQ ID NO: 120853 - DNA, 570 bp, Homo sapiens
  Payload ID: 3677
  Gene Symbol: CCDC155
  Gene Name: coiled-coil domain containing 155
  ENST ID: ENST00000598730
  CDS Start-End: 296-570
gttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagaaagaggtaacaccaaccccattttccagaggaagaaactgaggcccaagagaagttgagtccattgccccagtgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagagga

SEQ ID NO: 120854 - DNA, 776 bp, Homo sapiens
  Payload ID: 3677
  Gene Symbol: CCDC155
  Gene Name: coiled-coil domain containing 155
  ENST ID: ENST00000594043
  CDS Start-End: 198-776
cgaaatcctagcgaagcccccccatattgtgggagagatacccctgcgtcagggccccccagatcctgaccacttgggaggccgaggcgggcggatcacgaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggagggg

SEQ ID NO: 120855 - DNA, 473 bp, Homo sapiens
  Payload ID: 3677
  Gene Symbol: CCDC155
  Gene Name: coiled-coil domain containing 155
  ENST ID: ENST00000597993
  CDS Start-End: 127-255
gttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagtgctccagaaggagagactgccctgttggctgggaccccagagcaactcctgactcactgtgggagctcacttactgttgagtgaacggacggatgaaagaggtaacaccaaccccattttccagaggaagaaactgaggcccaagagaagttgagtccattgccccagtgtacctccgggagcggcctgaggaggcaaggctgggaatgccggtcagcttggaggagcaaatactcaactccacgttcgaagcttgtgaccctcagaggacaggcactgtggctgtggcccaggtgctggcc

SEQ ID NO: 120856 - DNA, 2052 bp, Homo sapiens
  Payload ID: 3677
  Gene Symbol: CCDC155
  Gene Name: coiled-coil domain containing 155
  ENST ID: ENST00000600570
  CDS Start-End: 1-1573
caactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccag

SEQ ID NO: 120857 - DNA, 768 bp, Homo sapiens
  Payload ID: 3677
  Gene Symbol: CCDC155
  Gene Name: coiled-coil domain containing 155
  ENST ID: ENST00000595828
  CDS Start-End: 204-768
cgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaagaaagaggtaacaccaaccccattttccagaggaagaaactgaggcccaagagaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttgg

SEQ ID NO: 120858 - DNA, 3001 bp, Homo sapiens
  Payload ID: 3678
  Gene Symbol: CCDC157
  Gene Name: coiled-coil domain containing 157
  Uniprot ID: Q569K6
  ENST ID: ENST00000338306
  CDS Start-End: 661-2919
cccttcatagcggccggccgcttattcctgtgcgagtaaggagcgcccaggccaaccctccggctgcaggctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccgcgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacgaccttcaagaacaccaggagtgtccactcccagaccattgagacggccctggtgccctgtgacgcatgcgccagcgtccagggaagcctgcagaaggtgggcaaggtggtcatcagcctgtgtcagagccagaacctgccctcgtccttaggccagttccagcaactggtgcaggacagcatggggctcaggccactgccggctgccaccgtgggccgctgggcagcagagcagaggaaagacctgacgcgcctcagtaagcatgtggaggccctcagggcccagctggaggaggctgaagggcagaaggatggcctgaggaagcaggcgggcaagctggagcaggcgctgaaacaggagcagggggcacggcggcgacaggcggaggaggatgagcagtgcctgtctgagtgggagcacgacaaacagcagctgctcacagaaacaagtgacctaaagacaaagatggccaccctggagagagaactgaaacagcagcgggagtccacacaggctgtggaggcaaaggcccagcagctgcaggaggaaggtgagcgcagggcggcagcggagaggcaggtgcagcagctggaggagcaggtgcagcagttggaggcgcaggtgcagctgttggtgggtcggctggagggcgctggccagcaggtctgctgggccagcacggagctggataaggagaaggcccgtgtcgacagcatggtccgccaccaggagtctctgcaggccaagcagcgagccctgctaaagcagctggacagcctggaccaggaacgtgaggagctgcggggcagcctggacgaggctgaggcccagcgggcccgcgtggaggagcagctgcagagcgagcgggagcaggggcaatgccagctcagggcccagcaggagctgctgcagagcctgcagagggagaagcaaggcctggagcaggcgactacggacctgcggctaaccatcctggagctagaacgggagctggaggagctgaaggagcgggagcggctgctggtggccttcccagacctgcacaggcccaccgagacccagatccatggaggcagatccagcagcgtggaatcccagataacatgtcccacagactctggcaacgtcacagatcacatggagaggcaagtgcagtccaacgacatccgcatccgggtcctacaggaggagaacgggcggctccaatcaatgctgtccaaaatccgggaagtggcccagcagggtggcctcaagctgatcccgcaggaccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagc

SEQ ID NO: 120859 - DNA, 1759 bp, Homo sapiens
  Payload ID: 3678
  Gene Symbol: CCDC157
  Gene Name: coiled-coil domain containing 157
  ENST ID: ENST00000399824
  CDS Start-End: 664-915
aagcccttcatagcggccggccgcttattcctgtgcgagtaaggagcgcccaggccaaccctccggctgcaggctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccgcgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggtgagggccttgaccaagcctggtcatctcaggatgccagcacctgcccctgaaaccagtggcagctacggaagcccctccagaggcaggggtgatgttggaacaacagtcaccattgagtacctgtcggggccacatcagctcaggactttcaaagtggtcttaccttttatcatgtgtcttgtgttgtgtgctgtgctatcctgtgttaggctctcctagcctgtccacctcaggcagttgatttccattccatcggtctctgtggcaccacagctgtgaccacggtctctcagcctctcccagctgcctcctcagggtttctatgttggggaccccatagttgcttctcagagtttccattccgggctctctttcctgttgtcctgtgggttgtgctgttccctctgcatatcacaaggccggacacgggatgtggttttccaaatcctgacccgctgggaagagccttgctgattctcctgcagcctcatcacttctaagctatcattaaagttaacatggttggccgggcatggtggctcacgcctgtaatctcatcactttgggaggccaaggcgggtgcatcacttgaggtcaggagttcaagaccagcctggccaacatagtgaaaccctgtctctactaaaaatacaaaaattagcttggtgtggtggtgcatgcctgtaattccagctactcaggaggctgaggcatgagaatcgcttgaatctgggaggcagaggttgcagtgaaccaagatcacaccaatgcactccagcctcggtaatggagtaagactttctcaaaaaaaaaaaaaagtgaaaataaaaataaagttaacatgg

SEQ ID NO: 120860 - DNA, 3052 bp, Homo sapiens
  Payload ID: 3678
  Gene Symbol: CCDC157
  Gene Name: coiled-coil domain containing 157
  Uniprot ID: Q569K6
  ENST ID: ENST00000405659
  CDS Start-End: 710-2968
aagcccttcatagcggccggccgcttattcctgtgcgagtaaggagcgcccaggccaaccctccggctgcaggctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccgcgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagagcagccacgtggctctggctggcagggctcttctctgctcaccccaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacgaccttcaagaacaccaggagtgtccactcccagaccattgagacggccctggtgccctgtgacgcatgcgccagcgtccagggaagcctgcagaaggtgggcaaggtggtcatcagcctgtgtcagagccagaacctgccctcgtccttaggccagttccagcaactggtgcaggacagcatggggctcaggccactgccggctgccaccgtgggccgctgggcagcagagcagaggaaagacctgacgcgcctcagtaagcatgtggaggccctcagggcccagctggaggaggctgaagggcagaaggatggcctgaggaagcaggcgggcaagctggagcaggcgctgaaacaggagcagggggcacggcggcgacaggcggaggaggatgagcagtgcctgtctgagtgggagcacgacaaacagcagctgctcacagaaacaagtgacctaaagacaaagatggccaccctggagagagaactgaaacagcagcgggagtccacacaggctgtggaggcaaaggcccagcagctgcaggaggaaggtgagcgcagggcggcagcggagaggcaggtgcagcagctggaggagcaggtgcagcagttggaggcgcaggtgcagctgttggtgggtcggctggagggcgctggccagcaggtctgctgggccagcacggagctggataaggagaaggcccgtgtcgacagcatggtccgccaccaggagtctctgcaggccaagcagcgagccctgctaaagcagctggacagcctggaccaggaacgtgaggagctgcggggcagcctggacgaggctgaggcccagcgggcccgcgtggaggagcagctgcagagcgagcgggagcaggggcaatgccagctcagggcccagcaggagctgctgcagagcctgcagagggagaagcaaggcctggagcaggcgactacggacctgcggctaaccatcctggagctagaacgggagctggaggagctgaaggagcgggagcggctgctggtggccttcccagacctgcacaggcccaccgagacccagatccatggaggcagatccagcagcgtggaatcccagataacatgtcccacagactctggcaacgtcacagatcacatggagaggcaagtgcagtccaacgacatccgcatccgggtcctacaggaggagaacgggcggctccaatcaatgctgtccaaaatccgggaagtggcccagcagggtggcctcaagctgatcccgcaggaccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagcaa

SEQ ID NO: 120861 - DNA, 732 bp, Homo sapiens
  Payload ID: 3678
  Gene Symbol: CCDC157
  Gene Name: coiled-coil domain containing 157
  ENST ID: ENST00000445005
  CDS Start-End: 144-732
gacgccgttgccaaggcagcggcctgagcgcccggctagggcttttcggggatcccggtggccgcaggcgcaccgggggcagttccgggagccgaccagacacgaaggctgaagccgcgacgccgaagacaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgc

SEQ ID NO: 120862 - DNA, 894 bp, Homo sapiens
  Payload ID: 3678
  Gene Symbol: CCDC157
  Gene Name: coiled-coil domain containing 157
  ENST ID: ENST00000430839
  CDS Start-End: 292-894
gttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagaggatctgtgaggatggcgcacctgctgggcagccaggcctgcatggagagcctgcgcacagacctcaccgacctgcagggtgccatcgtagacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagagagcatccctgtcagagcctccctgcagttcccagccacg

SEQ ID NO: 120863 - DNA, 3663 bp, Homo sapiens
  Payload ID: 3679
  Gene Symbol: CCDC158
  Gene Name: coiled-coil domain containing 158
  Uniprot ID: Q5M9N0
  ENST ID: ENST00000388914
  CDS Start-End: 154-3495
gcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaagacagaagagctggaaaagcagttagtccttgccaactcagagctaactgaagcccggacagagcgtgatcaattcagtcaggaatctggaaatttagatgatcaacttcaaaagctgttggctgatctacacaaaagggagaaggagctgagtctggagaaggagcagaataagcgtctgtgggaccgagacacaggcaacagcatcaccattgaccacctgcggcgggaactggacaaccggaacatggaggtgcagcgcctggaagccctgctcaaggccttgaagagcgagtgtcagggccagatggagcggcagatggcagcaattcaaggaaagaatgaaagtctagaaaaagtatcctccttgactgctcagcttgaatccaccaaagagatgctgcgcaaagtagtagaagagttgacagccaagaaaatgactctggagagctcagagaggacaatatcggacctgacaacttctctccaggaaaaagagagagccatcgaggctaccaatgcagagatcacaaagctccgctcccgggtggacttgaaattgcaggagctgcaacacttgaaaaatgaaggggatcatctcagaaatgtgcagacagaatgtgaggccctcaaactgcagatgacagagaaggacaaggtgatcgagattctgcgacagcagattgagaacatgacacagctggtgggccagcatggacgaactgctggagctatgcaagtagaaaaagctcaactggagaaagaaattaatgataggcggatggaactaaaggaacttaagatattaaaagataaaaaagatgcaaagatccgggagcttgaggccagagtgagtgacttggagctggaaaaggtgaagctggtgaatgcaggctctgagcggctccgtgcagtgaaggacatcaaacaagagagagatcaattattaaatgaggtgaaaacaagtaggagtgaattaaacaatctttcagaggagtatgaagtcttaaaaaggaatttccgaaacaaaagtgaagaaatggaaatgactacaaataagttgaaaatgcaattaaaatctgcacagtctgaactagaacagacaagaaatacattaaagtcaatggaaggatctgatggtcatgctatgaaagtggcaatggggatgcaaaagcaaatcacagccaaaagaggtcagatagatgcccttcagagcaagatacagtttttggaagaggcaatgacaaatgcaaataaggagaaacattttctgaaagaagagaaaagtaaactcagtcaggaattgagtactgttgccacagaaaaaaacaagatggctggggagttggaagttctgcgatctcaggaacgccgtttgaaagaaaaggttactaatatggaagtggctctggataaggcatctttgcagtttgcagaatgtcaagatataatacagcgtcaggagcaagaatcagtgcgcttaaaacttcaacacactttggatataaaagaacttcagggccctggatacacctcaaattcttcattgaaaccacgccttctccagccagcatctgttactcgttctcattctaatgtaccatcttcgcagtctacagccagcttcctgtctcatcactctacaaaagctaacacactgaaggaagatccaacaagggacctgaaacagcttctccaagagttgagaagcgtgatcaatgaggagccagctgtgtctctgagcaagacagaggaagatggaagaacatctctgggagccttagaggatagggtaagagattgcattactgaatccagcctgagatcagacatgtgccatagaagcaacaactcgttgagggactccactgaaggaagcaaatcaagtgaaactcttagtagagagccagtcacattacacgcaggagacagggaagatccctctggttgcttcacattcacatctgcagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctattttgaaataaactattcttgaatccctcacagtaaa

SEQ ID NO: 120864 - DNA, 1728 bp, Homo sapiens
  Payload ID: 3679
  Gene Symbol: CCDC158
  Gene Name: coiled-coil domain containing 158
  Uniprot ID: Q5M9N0
  ENST ID: ENST00000434846
  CDS Start-End: 172-1392
acttcctaaaaaacgatagcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaaggagaacctccagaattcccctttacgaatttggaccagtagaagctgtcactattggctctgtagatttggctttacccttaactttcgctttttgacaacaaaaatatctcctgatgttgattcagcatttatttttactactttgaaagcagttggggctgaattttgtattaaaaaagtgatgatttagtagcactggctggagctatatactgtgcaggaagattctgtgcaaacctctgcatagttctgccaatgcaccgccatgctggcctgtagcatcccttattattccatagctgtgtctttttgagcacagaaaaacagaaaacaccaccaccaacagacaaaccaaacctcgtgtgatttgatatgattggcaatatctctaaaatcaatgtgagattagaatgaaatcccaatactcatttgtccagtgatccaaaccaaaaagtgcattcatagatggtgaaagggaaaaccagtgctactacgtaaaaataaaagaaaaagaaaaaatctttaa

SEQ ID NO: 120865 - DNA, 1062 bp, Homo sapiens
  Payload ID: 3680
  Gene Symbol: CCDC159
  Gene Name: coiled-coil domain containing 159
  Uniprot ID: P0C7I6
  ENST ID: ENST00000458408
  CDS Start-End: 103-996
acacccctctctgtgactcagtctctgagcgttttaatacgatggtgtccccgcgggatcaaacttcagcgtcacagctgaggactggcttcgtggtccctgatgggagagcatgaacaggtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccgcttgagcagccgggactgctctccctgaagacccctccagagagaaaataaactagcccagaccctcctct

SEQ ID NO: 120866 - DNA, 658 bp, Homo sapiens
  Payload ID: 3680
  Gene Symbol: CCDC159
  Gene Name: coiled-coil domain containing 159
  ENST ID: ENST00000591691
  CDS Start-End: 1-467
atcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctct

SEQ ID NO: 120867 - DNA, 458 bp, Homo sapiens
  Payload ID: 3680
  Gene Symbol: CCDC159
  Gene Name: coiled-coil domain containing 159
  ENST ID: ENST00000592723
  CDS Start-End: 68-178
aatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacag

SEQ ID NO: 120868 - DNA, 527 bp, Homo sapiens
  Payload ID: 3680
  Gene Symbol: CCDC159
  Gene Name: coiled-coil domain containing 159
  ENST ID: ENST00000586451
  CDS Start-End: 107-527
gcgttttaatacgatggtgtccccgcgggatcaaacttcagcgtcacagctgaggactggcttcgtggtccctgatgggagagcatgaacagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctcc

SEQ ID NO: 120869 - DNA, 396 bp, Homo sapiens
  Payload ID: 3680
  Gene Symbol: CCDC159
  Gene Name: coiled-coil domain containing 159
  ENST ID: ENST00000590919
  CDS Start-End: 103-213
acacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagca

SEQ ID NO: 120870 - DNA, 602 bp, Homo sapiens
  Payload ID: 3680
  Gene Symbol: CCDC159
  Gene Name: coiled-coil domain containing 159
  ENST ID: ENST00000588592
  CDS Start-End: 215-602
aatacgatggtgtccccgcgggatcaaacttcagcgtcacagctgaggactggcttcgtggtccctgatgggagagcatgaacaggtgccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgc

SEQ ID NO: 120871 - DNA, 580 bp, Homo sapiens
  Payload ID: 3680
  Gene Symbol: CCDC159
  Gene Name: coiled-coil domain containing 159
  ENST ID: ENST00000591260
  CDS Start-End: 1-580
gagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggcc

SEQ ID NO: 120872 - DNA, 534 bp, Homo sapiens
  Payload ID: 3680
  Gene Symbol: CCDC159
  Gene Name: coiled-coil domain containing 159
  ENST ID: ENST00000587531
  CDS Start-End: 206-534
cgcgggatcaaacttcagcgtcacagctgaggactggcttcgtggtccctgatgggagagcatgaacaggtggtatgtgccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagct

SEQ ID NO: 120873 - DNA, 561 bp, Homo sapiens
  Payload ID: 3680
  Gene Symbol: CCDC159
  Gene Name: coiled-coil domain containing 159
  ENST ID: ENST00000590636
  CDS Start-End: 36-152
agcgtcacagctgaggactggcttcgtggtccctgatgggagagcatgaacaggtggctcttcctcggacaaggctctggagcgtacagctcactggtccaggactccagagccagagaccttgggatgccctgcttctggggacacagtgaggactgcagactgcaggccaggaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccag

SEQ ID NO: 120874 - DNA, 1408 bp, Homo sapiens
  Payload ID: 3680
  Gene Symbol: CCDC159
  Gene Name: coiled-coil domain containing 159
  Uniprot ID: P0C7I6
  ENST ID: ENST00000588790
  CDS Start-End: 448-1341
aagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgctccttcccacccgcttgagcagccgggactgctctccctgaagacccctccagagagaaaataaactagcccagaccctcctcta

SEQ ID NO: 120875 - DNA, 1299 bp, Homo sapiens
  Payload ID: 3681
  Gene Symbol: CCDC160
  Gene Name: coiled-coil domain containing 160
  Uniprot ID: A6NGH7
  ENST ID: ENST00000370809
  CDS Start-End: 322-1299
aagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccagatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatttaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaa

SEQ ID NO: 120876 - DNA, 1790 bp, Homo sapiens
  Payload ID: 3681
  Gene Symbol: CCDC160
  Gene Name: coiled-coil domain containing 160
  Uniprot ID: A6NGH7
  ENST ID: ENST00000517294
  CDS Start-End: 384-1361
aagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccagttcaaactggagaaggagggcagagatatccagtagacagaagatcttggaccccaggaagtatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatgaaatagaacaagaacaaaatttaagagagaacaagagaaacatttcaaagaatgaaacagacacaaattctgcatcctatgaatcatctaatgtggatgttacaacagaagaaagctttaacagcacagaagataactctacctgcagtacagataacttaccagctctactaagacaagacataagaaagaaatttatggaaagaatgtctccaaaactttgcctgaatcttttgaatgaagaactggaagaacttaatatgaaatacagaaaaatagaagaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatttaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaaaacttaaaaaaatccttccagtaggcaagtcattgagccaaatcagtgtttattgtattttctttgcgtattacttaaaatatatgtaataggatgttattttcattttcagtaaatcacagtatctataaaacatatacatgtttccaagcttctgctttctctttctgatgaagttattgcaggaatacaaatggaaacgaagctttggaaatctcatatcagagtgtgtgtgtgtgtgtgtgtgtgtgtgtgtacacacacacatatattcactcaaaaacacataatgattcaccaaatcatttatgaatacaaatcagcaattttgtgatctcgtaagcaaatatgtctttggcacgtgaatatttttccatctgtgttcattgatgttaacaataaaaatcttgtttatgtgtataagcctaa

SEQ ID NO: 120877 - DNA, 2229 bp, Homo sapiens
  Payload ID: 3682
  Gene Symbol: CCDC163P
  Gene Name: coiled-coil domain containing 163, pseudogene
  ENST ID: ENST00000626177
  CDS Start-End: 471-827
aaaggtagttccaccgcctccatcgccggttgtgttcgcaagaggcgacctcagtttcccaggtggcgctgcggcagccagtccaaagtcggactttcaaaaccaacccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtgggaggagtcagagattatgcagaaggaattgaagttgctgcagtaccagttgagccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctggacagtaggaggctacctttcctcatctccagcttctgccttttttttttttttttttgaggcaaggtcttactcagttgcccaggctggagtgcagtggcatgatcttggctcactgcagcctccgcttcctgtactaaagcaatcctcccaccttagccccccaagtaataatatatgggactacaggcacacgctatcatgcctggctaatttttaaatattttttgtagagacaggttttcaccatgttgcccaggctggtctcgaactcctgggctcaactgatccaccaactttggcctcccaaagtgttcagattacaggtgtgagctgctaccatgcctagccccagcttctactgcttgaggctctctttggcatctccacacatcatccttagcagcccagactgcatttctgtagcagcctcttccctggtctcttctttcagtctctctgcctctaatccagtggctttaagaattttttggctgtgacttccagtaagaaatacaatttacattgtgacctagtaaatatgtgtgtagatttattaactgaaataaaaatgttatgatttaatttttatccttagtgggagtgatacactgatattttctattatatttcattaaaaaatgccttgtgactaa

SEQ ID NO: 120878 - DNA, 1076 bp, Homo sapiens
  Payload ID: 3682
  Gene Symbol: CCDC163P
  Gene Name: coiled-coil domain containing 163, pseudogene
  ENST ID: ENST00000628293
  CDS Start-End: 366-659
acccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtgggaggagtcagagattatgcagaaggaattgaagttgctgcagtaccagccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccat

SEQ ID NO: 120879 - DNA, 953 bp, Homo sapiens
  Payload ID: 3682
  Gene Symbol: CCDC163P
  Gene Name: coiled-coil domain containing 163, pseudogene
  ENST ID: ENST00000629482
  CDS Start-End: 366-803
acccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtgggaggagtcagagattatgcagaaggaattgaagttgctgcagtaccagttgagccagcaccaggagctgctgctgaaacagctggctgagggacgacaggctcaggttggcagttggaagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccat

SEQ ID NO: 120880 - DNA, 2053 bp, Homo sapiens
  Payload ID: 3682
  Gene Symbol: CCDC163P
  Gene Name: coiled-coil domain containing 163, pseudogene
  ENST ID: ENST00000625766
  CDS Start-End: 440-640
gtgttcgcaagaggcgacctcagtttcccaggtggcgctgcggcagccagtccaaagtcggactttcaaaaccaacccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcaggccagcaccaggagctgctgctgaaacagctggctgagggacgacaggctcaggttggcagttggaaggatctccattcatgttgtccaatctaagctgcctctgcccactaccttcaccatgtctgtttcttcatccagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctggacagtaggaggctacctttcctcatctccagcttctgccttttttttttttttttttgaggcaaggtcttactcagttgcccaggctggagtgcagtggcatgatcttggctcactgcagcctccgcttcctgtactaaagcaatcctcccaccttagccccccaagtaataatatatgggactacaggcacacgctatcatgcctggctaatttttaaatattttttgtagagacaggttttcaccatgttgcccaggctggtctcgaactcctgggctcaactgatccaccaactttggcctcccaaagtgttcagattacaggtgtgagctgctaccatgcctagccccagcttctactgcttgaggctctctttggcatctccacacatcatccttagcagcccagactgcatttctgtagcagcctcttccctggtctcttctttcagtctctctgcctctaatccagtggctttaagaattttttggctgtgacttccagtaagaaatacaatttacattgtgacctagtaaatatgtgtgtagatttattaactgaaataaaaatgttatgatttaatttttatcctt

SEQ ID NO: 120881 - DNA, 1526 bp, Homo sapiens
  Payload ID: 3682
  Gene Symbol: CCDC163P
  Gene Name: coiled-coil domain containing 163, pseudogene
  ENST ID: ENST00000626657
  CDS Start-End: 366-722
acccgaagttttgaacccggcggcggcagttgtcactggcacaggtttggcgtggtggcgccagtgtactacttctggggaggtctcaaccaggttctggcaccttcaatccccacctgatatctgcgtatcatcacggtatcccgcttttcccccagttccccaagagcgtccttcctttccctagtcacaggatcgcagttttggtctgatagtgcatccacctaccccagtgttgcatccccacttccctctttccatctaacgtggtggcctttcctggggataccttgggtatcccccgctaggagagcaagcacaagacaccagggagccagacccctgccgctcccctgccacaggatatgaatacgagcctcagctggtttgagcagctggatgtgcttctcaacgctactgatggaaatgtggtccggaataagcagtggctgtatcctcttggggtctccacagagctcattggcctgtgcatctgtttcttctgtagcagtggctgtatcttcttggggtctccaccgcagaatagcactgctgtcactcctgcagtgctgtgggaggagtcagagattatgcagaaggaattgaagttgctgcagtaccagttgagccagcaccaggagctgctgctgaaacagctggctgagggacgacaggctcaggttggcagttggaagctcttaattcagtcttctggacagtaacagtagctgggaacttttatggaagccagatccccagaggagcaccctttctaacctggagcccagcatctttcagctccatgcccagagtcttaagcaagaggacctattcctttggggccccaaaatgctcctgaatgacctgtaaggactcgttaagaatagtaggatgaaggcttctttgcccaccctcccctccaaggccctgtttctgggctgcccgcccctaccttcttgaagtagctattatctgtcttatctactgaggcttttcactgcctgcccatccttgccccccatctcagctcactgcaacctccgcctcccaggttcaagcaattgtcctgcctcagcctcccaagtagctgggattacaggtgtgcgctaatttttgtatttttagtagagatggggtttcaccatgttggccagtctggtcttgaacttctgacctcaagtgatctgcccgcctcgccctcccaaagtgctgggattacagttgtgagccaccatgcccagcctatagctgtaccttctgagtgcaagctcagttgaacttggaaagtaatgggagttcccattctggtgagtagaatgaggtaggacactgctctagggcagtagtgctgggggatgcaaaggaggatgagatattctggtgggacttggatctggacagtaggaggctacctttcctcatctccagcttctgccttttttttttttttttttgaggcaaggtcttactcagttgcccaggctggagtgcagtggcatgatcttggctcactgcagcctccgctt

SEQ ID NO: 120882 - DNA, 1320 bp, Homo sapiens
  Payload ID: 3683
  Gene Symbol: CCDC166
  Gene Name: coiled-coil domain containing 166
  Uniprot ID: P0CW27
  ENST ID: ENST00000533508
  CDS Start-End: 1-1320
atggcgcccaagaaaaagcgcgggccgagcgcagggagccagccaggtggtgcggcggccgcgggtgccgagcagccgctatcggagcgcgcgcagtacctgcaacgcgaacacgcgctgctctcggagcagctggacacctgcgaggagagcgttgaccaggtgctgcgagagaacgccttcctggaccgcgaggcgctgcgcctgcgcgaggagaaccggctctacgccagctacgtgagcgcgcgcgcccagcgctgcgccaaagccatcgtccggctggacgagcagaaccgcgtggacctagcgcagatccactggcagcgggcggaactggcctcgctctaccacgggcgcgaggacggggtgcgcgcgcagctgttggagatggaggcgcgcgcggcacagatggcacagcaggtgcaagagctgcagccctacaaggtgctgcagctggagcagctggcccggatccgggcgctggagcgcgagctgctgcatatgcgcgtggagcacacgcagctgctccaccgcgtgaagcggcgcttcctggaggacaaggcggccttcgagcgcgaggcgcgtcagcgcgtgcagtcactggcgcggcgcgcggagcgggaggcggtgcgcgcgcttgtggcgcacacgcaggccatcaaagcggacaacggacgcctgcggcaggagctgctgctgctgctccgccggacccagctgctgcaccacacgcggcgccagctgctggaacagcgcgagcaactgcaccgcgagcacgaggacacgcgggacctggcgcgtgtgcacggctggctgcgcaggggccccggaggcccgccgctctgggagcggccggccttctcccagcccacctcgcgccccgggtcattagccgcccccataagcccgtcgcgcgcggcctcccagaccccgtctgtggtaccgtcgcgcgcggccccccgggcctcgtccgtggtcccgtcgcgcgaggcttcccgggtcccctcgttggtgctatcgagcatggactccagggtcccatcgctggccacttcaaaggtgggatcccggatgccatccctgaccgcttcgcgcgcaggctcccgggccctgtcgctggtgcagtcactcgagggctctgggatctcttcggggtcctcaccgagggtgtcctcacaggacactctccgctccacgaagtctggccccaagcttctctctggcctgtcccgggatcgggatccggctcttctccccccacagtcggaggacagcgtgaacgctgaagctgcggcagaagcctccccgggtagagcctga

SEQ ID NO: 120883 - DNA, 1320 bp, Homo sapiens; identical to SEQ ID NO: 120882
  Payload ID: 3683
  Gene Symbol: CCDC166
  Gene Name: coiled-coil domain containing 166
  Uniprot ID: P0CW27
  ENST ID: ENST00000542437
  CDS Start-End: 1-1320

SEQ ID NO: 120884 - DNA, 619 bp, Homo sapiens
  Payload ID: 3684
  Gene Symbol: CCDC167
  Gene Name: coiled-coil domain containing 167
  Uniprot ID: Q9P0B6
  ENST ID: ENST00000373408
  CDS Start-End: 60-353
gcgcacatagcgacttggtgggcgcgtccagtgatgactgggggatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttgatcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgttcccgtctgctgagtaaa

SEQ ID NO: 120885 - DNA, 21466 bp, Homo sapiens
  Payload ID: 3685
  Gene Symbol: CCDC168
  Gene Name: coiled-coil domain containing 168
  Uniprot ID: Q8NDH2
  ENST ID: ENST00000322527
  CDS Start-End: 139-21384
acttgataagataccagcagcactggccaaatgttgcacatggttatgagttgggcataccgaggttttatatttcagggcctctgaaatcaaggacttctgaatgagacaccagtctctttcacatatgacattaaaatgtcaaagcaatattattcctttaaaaaaggggtagggagtggactggaagataatacattcatgacattatgggactttctagagtcctggattattcaaaatgattgggtggcaattttctttataattttactaggaattatttttgagataatactcatgaaagcttgtgcatccttttggaagaagcccacacttcctgaaaagggtagttcagatgtccaggagacggaagacagttgccccaaaagcaggaaacttgctccagagaattggtcagttattaattcatcttcaggagaaagagttggcacctttttagaaaaaagaattacttcatcacttacatctgaagaaaaggaatgtaactttgaagatagaattttattctcacgtgaaatactatggtcaggtactagtgaaagtgaagatcaagtaagtccctctagtgaaagtcatgtgccatcttcaaatggaatcagctcatctttgccattgttttattcagaagtagaggaaacgtgtctaagccatacagagcatccagacagagaatatgaaacaatacaattttcctccaagaaattattttcaatgatgaaaaccaacaaaaacaaaaattcaggattttcttctgatcttagcttttcagcatctagattcactgtagaaaatgaagatctagatgtggcaccttgccctcttgcccacttatttctttctagagatcaagttagacttctggaagaaaatgtgaggaatcaaattccttcaaaacccaaaactaagttagggagcagaactacttatcaatgctcaagatctcaagagtccttgaatcagaatcaaccttctgttggaatggttatttctgtccaagcacaggattcttttccaggacaaaatgcttttcagaatcaaggtctttatgaagtccaatttactagtcaagcccaatatataaatcataaccaagaatcaattaagagccagcctgagagcaaagccagcaactttgcccagcctgaagatgtgatgaagaagccattttctagcagcacacaagactccttccagtcccaagatctggataggaaccaacattttgttgaagttccatcaattgttgaggcaaaatattcagtaaagggcctggagtctgatgaacacttaggtgaggaccaacattgtgtttggtttatagattcaaacaaggttaaatattcaattaaggggcaagacactatttttaagaatgctgaatttctcgttttaactctgaatccaaatttagtcactgaagatatgccacaactaaggagtgtaaaagcacaaggccagcaacaaattgtttcatcagaattgaaccaggattctgtatatagctcagtgcctcttttgtctaccattaaagggcagaaaaatagaagaaaaacaccagacagtaaaagcaaactcagtcttaatgttccatctctaaaagccaaaaaaacaccaacttcacaagtatttcaaatcacagtatgtcacactttaaaaaataggaatgagttaggatgcaagaataacactgagaagaaagaattacatgaaaggaaagatatatcagatatagctttgcatcttatttctgtttccaagcttattctgccttatgttaaaaattattccagaaaacaactagtgaaagtcatgccgggtttaataaaatgtggacattttctgcagaagcaaaataagtcaccagatacagagaaaatcaattatgcaggtcctcttgaggagacaggaatctcagatattactaaaaaggaaaaggagtatgacaaagaaaacaaaagactaaaaaacatttcaccaaaaatgttacctcagctagaacaatccttcatggtcaacactgttcaactaaaagcaccttgtttactagtagaaacaaatgggaagagtaaagaatctcttaaagactcaattacacaagcaaagggaattggtattacagaatttcatgttctaaatagtaaaaaaccatttgatctccatattccaaagcacaagacatctttagaagaagctatatcaaaacctatgcagaaacttgtttcctctcctgaaatggaatcgaacaatagaatgaaaatacaggaggacctacaaagttcagaaaattcccatcttcaactttcaaatggagaggagttaccaaccagtacaccaaaaacgcaaaggtgctttccaagggaaaatacacagaaacaaaaagattttttggaacttgttctggagttgtcaaatgtcggtttgctcatttccccaggaagcaaaatgcataaaagcagtgaagaattagaagccataaaaattcaagtgaatacagaaagtgtaaatctgaaggaaagtaaaccattgatacttaatgttacagaagacagtgacctacgtgaaagtgaggaactggaatgcaacactggaagtaacataacaaatatgcatcaagataaagaaacgtctgatgcatttcacagtgccacttacactaccatttctcaactacctgatacagaaacacatagcatatcaaaagccaaggcagacacattaagaataataaggctcagtcattcagcatcaaagcaagagaaattaccagatgagaaggaaacacagaacgcagaatacattgataagagctgtacatttaaaaagccacaacaatgtgatagaaaggaacaggagaaagaggcaaattcagagctgacacaaggcttcaggttcagcatacatctaaagcaaaagcccaagtatgtcaaattccaaatggaacagatcagttcaggaagtagtaaagccccaaataaagagcaagaagtccaaccacaaactctttctacacaaactattttggagaatagtccatgccccatgatggatccatttcaagttgagaaggtgaagcaaagcacagatagacctacagacagagagagtgccggagatccaaagaatccacttacaatgccagagaacttgccagttggtgaacttttaattgaaacaacagagtatagtgtcccatttggtggaaacctccaaaagacaacggatagtcatattgcagaagaaaaggaagatgtaaaaagatatttacctgcagttgccctggggtctttcaataaccacttgcttactttaccatattttaaaaggcaggaaattaaaaaaaaattatcagaaacaaaaagtgtactcagtgtcaaatatgtaattatgaaagtaaagaagccagcaatctcactgatgccttatattaatatatgtggtacttcaaaccacaggaaaaaaatgggaggcaattttgaaattataattaaacagatactgcaagataaaattgcagcaggtatgcttctgaatgttatttaccctcccatgtctattttgcctaatactagaatgtatagcagattaaatgcagagaatcacagtcatatcaagctagtccaagaggaatcccaaattgaaagggaagaaaagtatccatatttcattaatgagggaaatgaatcccaaaacacactagatgctaaattgcaagatgaagtaaaaggcgtcaaagaaactctaccaaaagcagtcctgcatgatagctgcaaccttggacttgatgcacatctagagaaggagattaaaacagagaaagaaatgcatcaaccaatcccattcacagaaactattattgagtctgttgtttctcccataatggaactatctcatgctgagaatgtgaagagtactcaaaaaacacaaacagactgcaaatgcactgcagattcagagacgccttctccaatatcaggaaaatcactgattggagaccctttaaaccaaacaagagaaagttatattccaagtaatggaagtgatacaagagaaatgggttactgttttgcagaagaaaagacagaaataccaaaagatttaccagcaacttcgccagagactttcaattattgcactcctgttttatcttgttctaaagtgatgaaaaagagagtaacatttgcactcacaacaagtacagcgaagcccaaatgtgtaaatacaaaggctgtgaagccatcaatctcagagacagtcagtgtcacaagccacagaaagaaatcagaattagactttaagactaagtttaaaaagataaaccaaactaaaggattggtacctgaatgtctaaataccctttgctctccaatgcatagcagattgcagagagagttctgtctccctgcgtctcaattaaagcaaggagaaacagcagataagacatacactgatgtctttgctaagaatagcatatcccatgacagagaggaaaaattgcaagatggaaaggaagaggaacataaagttttattagaagcagcgccacagctgagccagcacctggggtctgaggcgggtcaaatgaaggaaatccatcttgaatcagacccagtgctgaactgtttaacactggagctacatattaatggacaacgtttgcagcaccaaacaggttttgaacaaactactttagagactagtctccaaatgggtcctttagaagctgaagaactacaaaaagccaacgaaacagaaaatgacataaaagtccttggaggtcctaagattccacctcccaaagctttacaggctctggagaacagcgatggcttaatactcaatgcatatcagaaggataatgagcttgtcaaatcagatgaggaactgaaccaaccaggaagtacaaatattcaggtacaaccacaaacacattttacacaaactattttgaagtctacttcatgccctacactggatcaatttccatttgaaaaggtagagagtcatgttaggttttcacctctaaagtctggggaagcaaaggttgatgaaatcatattttatgcaagagaaggtggtatctcatctgattctagccatcaaaaggaacaggctggtggtactgaaaagaaagagacagcgatttttggttcctgcatgcctgctttatctacacctaaaacgacgagaaacttaaaacaattttcagacatgaaaactttagtgaatcccaaatgtggaattataaaggcaaagaagccatcaatttcatacatgctcaatatcagggctggtgctggtccgaaacgtagaaaagaactgagctgtaacttgacaaccaaaatgaaagaactgcatcaaggcaaaaagggggtagatgaaacatatgctttcctgactatgacacctgacattaacaagtatagcaaggtagaaacagaaaaagacacgctaagagaaaaaagactcagttctactcaagtaaagcaagatacatctccacatgaagatagtattacttcacgtgacattaaagaaacccttcttcaagatgaagagcaagaagaaaggaaacaggaggcattgttaaaagtaattccacagcacctgcaacatttcatgttccgttcaggtcaggggaaggatcttgactttcacaaattagaaaaccaaggaagtaggaaaattctgtttgttaccaaacaagatgtcccacagcaacttcagcctgcagagccaatacaaagagaggagacaaagaaatgcctccagacccaaaatggcacaatatgtacagtaaattcaaaacttcttcctctaaaatcagaggactcagtaaatggtgaagttttaactggtgcaataaaacgtggtgtaccaactgataggaaatgtatgggggaacagcacaattcaggtaaaggggaaaaggcagagtttaataaagatctacaagcaactgtcctggagttacagaaatcaccacatggtggggaggcacagaaggccaatttgactgacatggaaagtggatctagtaatgcaatgaacatgaatgtacaacatgaaagggaagataaaaatattcaaaaaatgttaacagaatcagttccatgctatagtcaacacctccgtttcagtacacatcaaatgaaagatcctgacccttgcaaatcaggatctgaaccgaagagtcccgaaggcagatcttggaatttgtctcacatagtgcaaaaaacaaagcaagaaacacactttagagaaactgttttagagcctatttctggatacatgatgaaacaaagtcctcatatgcaagaaggaataaaatgtatggaaggtctaaagacttcatttcccaaaacagggaaatcaaagattggttcaataccacgtgataccccttgggatgaaaatcctagaaggaaatgggatagttctatttctgagaaaactgcatggaatcaaaaaaacttacaaacagtcttaaaacctttagatttctccagcctcatgtcatctgaatatgaaagccggagctatacattagagtttataggcaagaaaagtatgagtcccaaatgtgtaactttgaaggcaaagcaactacgaattttgcagttgtttaatatcataagatattctacagaaaaccacagaaagaaaaagcaacaccgttttaagtacaagatgaaagggaagcaatggtacacaagtataggagaggcattactcagtgccactgaatatgctaagagtacaacatccaaatcaatgattgataaactcttatacaatacagcagcgaggtgcattctatctaacagaacacgccgacaaaatctggatggtcatattacagaggaaaaggaagaggtacaagaaaatgtagctgcaattttcttgggtcttttagatttcttcatgcctgttttatctgactctaaaaaccagaggaacacagcacagttatcagaaaaagaaattatattcaatgccaaatgtttaactatgaaggaaaagaagtcgtcaatttcacagatacataaaatcaatagagagtctaccagaaaacataggaagaaatgtaaatcctatttaaaaactgtatccaacagaaagtgccaagaaaatcatggtcatattacagaggaagaggaagaagtacaagaaaactcacctgcaactttcctgggtcctttagatttcttcatgcctgttttatctgactctaaaaaccagataaacacaatacagttatcagaaaggaaaattatattgaatcccaaatgtttaactatgaaggaaaagaaaccaccaatttcacagatacataaaatcagtgggcagtttactacaaaacataggaagaaacttgaatccaatttaaaaaccaaactgaaagcaatgtggcaaggtgaaaatgtggctgatacatttccaaatacaacttccttcactccagattcctctgacattaaaaggcaaagtggattccaaacagagatagacatgagaatatcagggttaagtcatacacaaccaacacaaatagagtcactagctgaagggatagcaaggtattctgatcccattgacaagagaagaacttccaacttggtaaagggagcaaaactacatgatagagaaagtggggaagagaagcaagaacatcttacagaaatggatccattctatgcagaaaacttcatggcaaacacatatcttagaaaggatcgtcatcttggtaaatcagaggatgtgcttttgggagaaacttttttctcaaaaagtcagatttacaaagggaattcagaaaaaaatgtaaaaatagaaaaaaacaaaaatggaaaagaaagtctcaaagttgggctcgcaaggatggagaaatcagataattgtgcagaactgagtgaggcaacagatgatgccatatcaaacaaatatgataaacagaacattggccattctgttttaaaagaaaatgctttctgtaatttggcagcaattgtcccagattctgttggcaggcattcacctgcttcagaagaaatgaaaagacagaatggcagacttaaaatggctgacaggtcaagtccccaaggtagacctttgcaggcaaagcaatcagcagtttcacaatcacctgatactgcaggttatgctgttgtaagcaataataaggagcagaaacagaactttaaagcccagaagacagaagcagaagttgatttaatagatcaagaagcaaagataaatgttgcagaagagtttaatccagaatctgtttttttctctaagatacatccacttcaaattgaaaacaagaaagaatttaaaactgcagactggaaaacaagggcagatcccaagacatttgccctgccaaagaaacagcaagagctgtgtgtctcaggaactatctggagttatcctaatccctacacatctatttctcctaaaatcataagacataaagataaggcaaagacagcagatgtggaaagtactatgcataccaaacagataaaattgaaggcaaaaagaataacagtttcccagctgcttgagtatggtactgcaagcaataaaaaagaactgagaggtaacatccagcagcagaagtcattccagctgagtaaaaatgcagtacatcgagttctaaaggctgtttatgactctggatactgtgtgtctagcattaaaaagcttacagaagtaaaaatggagaaagacaagccaaaagacaggacatgcattcttccacagccaaagctggagaaaccactaaaagaaatgcaaaggtcattgtcaggttgtactgatatgtccagcattcttagaaaacaggaacaagatattagagaaaaggaacaaaaacaccaaagcatttcagaagacatatcccaatactatattggaccgttaaggattagttcacaacaaatcaattacagtagtttcgatgccccacgaattagaacagatgaagaacttgaattcctcattgcacaaagagcaaaggaaaaagatgtgggcattgccaaacattcagtttcaattccgtgggagagagaaggatcgaagagactagatattccactaaactcaaaaggacagaatatattttttacagagttggatacttctcaacagaagacttgccaggagcaagaattgctgaaacaagaagatatttctatgacaaacctggggtctatggcctgccccattatggaacctcttcatttggaaaacacaggaaaggtaactgaggaagaagatgtgtacattaacagaaaaattagttcacatgtattgggaaaagaaggattaaaggaaactgatatatttgtaggttctaaaggacagaaatttctttgtacaaattcagaggtacagcacaaagtgcctgcagagcagaaagaacaggtgaatccagatcatgttcccgaaagtattctggattctgaatctttcctcagtaaggaccctcttcacttaaaacaggcagtgaatacagcaagaaaagaaaatgttaccatctctgaaagtttcaatgaaaatctttggggaaaagagcaatcaaagttggatattacattaaaatcaaatagacagaaaatggacttttcaaaaaaattgaggatgaagcatctaagtaattattatcagaataaagagaatattctggaatctgttctcccttgcatattgcatcaactttatattgaaaatcccaagaaagaaggctcagcagaagaaatcatgagttcaaaagttctaagcccaatggtagagaaagcatcacatgaagtaggtattccggtggatcaacctccatgttcagaaggaatacatttgaatattaaaggaagaaaagaacatccacaagaaagtacacacgaggcttttccagcatctgtttctcactctttaatggacgtacttcagattaagtcaccaaaggtaaagaaagcattaaaggcaatcaatagtttagggtacctcacttcaaatacaaaaggaattggcttgctttttccaagacaggcagaaaaggaagaaaaatatacatacaaggctcttccaaagcctgcatctcactccaaaacagatctatttcagttcaatgcatctatgcaacaagagaaattagatgctatggatattccacattatgactatttaacttcacagacaagagaagcagtgaaacaaatggatgtcatagttggatatactcaaaacagtaaaaaaagacaagacttactcaaaacaggccaaaaatggcagtacctaccaatttcctatgagaacttttgggagcatatatcttgccctcaaaagtatccctgtctcctgcaacatttaatgcctcaggaaaaggaagcattatcagaaggaggtaatttatcaagccggacaccaggactagacttgttttctgcagatcagctaagcactataactaagaatagactagaatggattgtgcccttgatttctccaaggcagatgaaaaaacaagattcaatgctgcctttaggatcataccataaaactataaaatatgcaagtctcttatttccaaaaggaatgaaatcatcagatggggtacaggtctttgatttaatatcaaataatagctcacccaagttaagacttgggaagaagatagaaacacaaaaggcaaatgaaaaggtacaaaaagaagtatgtctgcctataacattacattctctttctgcatccatgcctattttgcaagaaagtaaaggacagaaggatagcgtagaacaagttattaggaaaggcgtgatatgccacaaaaggagaacttcgaaatggaagaaatcagtattttcacatatactcaataccagtgactgtggtgcctcaagtaacagactagaaatgcagtggaacatgacagacaaaatggtcaatgtgaaacatagaatgagtgaaatagatttggttgcagcaaaaatatgtgagtctattctttctttacctcacttcaaattgaataaagaaacaattgatggggtgatctcaagtaatgttaaaagtacaaaacaacacatatcacagggaaagaatgatagagtaaaagcaatggatatgaaaagaataaaaagccctaacatcattttgaagccaaggaagtcatcactgtcacatatactcagtataaaggaatttcctttgctgttagacattataaaacaagagggcaagatgcaagaaggtaaaggtaaatcaagtatgaaactgacaaacttgtgtacttctttaccatctctatcacatagtaattcaaattcaagaacaaaagcaggtaaagataagtcaggaactctaaagggctgccttccaccactaaagctccaggcatcatcaaatgccagaagagtatcatctgcagagtcaattaatagagacagtttaagtaatgtaatagaatcaaagtgttttccacagaaaaagaaggaagatagagaaaatatagtagatgtgaaagatgtaatgggcctcaaatgtatcactttgaaaggaaagaaatcactttttagacatttactgcatggaaaagaaccacaacggagcaataaaaaactagagaaaatgacgcaggaagatgaaagtaatctaaatgtagttcagaataaactctgtgcttctattctttctccacctcacttggaatggaatcctagaataaaagaggtatacatgagaggaataacaagattctgtctttcatcatcaacacagcaggaattatcagatacaatggaaaaatgtgagcagccaattgatgatagtttaagcagtattgaaaaagcaaaacatatgccgcagaaagacaaagacagagtggaaaaggctttggaaaaaatcatgcattccaaaagaatagctttggaggtgaagcagccttcaatattccaagaattagagttgaacatcaaagaaaaaggaggaaagattcaggaagataaagaagttgagatttggagcaaaccttttgcttccatctcttttctaccttactctaaagtgggcacaatagaaggagaggaagccatgagaataaaaatgagatcctctttttcacaaccaaatctccaagagtcatcagatacagagaaaacagcatatgaaaagtgtatttctgataatatctcaaacagtgtaaaaaaggccctagaatctatattgcaaaaagaacagaggcaaaaaatggaaaaaattagggctttgaagaaaatgaaatcatcaatttcacagggaattcagttggacattaaagagcaagagaaaaggatagaacatattaaaggtgaaccaagtgtgcttctgacaaatgcctgcgcttccattccttctccttctcatttacaactggatacaaggagagaaaaagcagagtatgtcactgaaataacaagatactatcttccagaactatcacaccaaaaatcatcagaggcaggggaaaaagcagatggagtggccagtaagggtgatatcacaatcaaagtacaaaaagcaaaagattacatgcaacagaaagaagacgatgaagtaaaaatatcagctaagaaagacataatgcatccagaagacaaaggtctgaaagcaaagaaggcactttcacaggacctaccattgaatactaaagagccagggaaaatggatcaagaagctcaggagcaagggaaagaggacagagaaggtgaggagcaagggaaagaggacagaagaggtgcaggacaagaaaaggttgatagagaagacaaagagcaagggaaaatggatcacgaagttgaagagcaacagaaagcagatggagtaggcatagagcaagggaaaatggatggagacaagaatgaacaggaaagagttctgttcctatatttgccttccaattcttctctaacccattatatattggacacaagaatagaaggagaggaagaccaacaaggaataatcagacctggtattttacaaccaaggcaccagaaatcatcagagacagggaaaaaagcaaatggggtgcccagtgagggtgatagcgcaagtgaagtacaaaaagcaaaagattacatgcaacagaaagaagaggatgaagtaaaaatatcagctgagaaagacttaatgcatccagaagacaaagatctgaaaggaaagaaggcactttcacagaacctaccactgaatcctaaagagccagggaaaagggatggagaaggccaggagcaagggaaagaggacggagaaggtgaggagcaagggaacagggatggagaaactgaagagcaacagcaagcagatggagtaggcacagagcaagagaaaagggatggacacaagagtaaacaggaaacagttctcttcctacatttgccttctgagtcttctctaacttgttatgaattgaacacaagaaaagaaggagaggaagacttacaaggaataataaaatctgctactttgcaactaaggcagcagaaatcatttgatgcagggaaaatagcacatacaaagtcttttggggtggatagctcaaatgatgtaaaaacagtacaagaatacaagccacagaaagaagtagatagaggaaaaacagtaagtgtggattatataatgcaacctgaaggcacaatttttgaggcagagcaattatcacttccacatacactcaatatccctggcagcagtggctcaaaaactagagaagtactaacaaacataaaagaaaaattgagacatgtacaggaaagaaaaagtgaactggatgtgtttctgacaataccttctctatctcactgtaaattagacaaacgaacagcaggcaaaaaagaggaacaaggagtaacaagatcttttcttccaccctcatggcacatggaatcatcagatacagggaaattaaaatatacattgtcatatttgaatgatatcacaggtgattcaaacagaacaaaatacatggcccagatccaaaaggataaagcaaatatttcagagaaaagtgtaatgcatcccgagtacatagctgtaaaggcagagaaatcacccctttcccatatactaaaaacaaaggaactgcaggtgaacatcagtcaacaaggggaaaaggcacaagaaggtgaggtggaaatagttgtacttctgagcaaaacttgtccttttgtcacttcttcagctttccttgagttagactcaataaaagaagaggaaggtgaaccacgaataacaagaagctttatgccacatcttgagatccaggaatcattgccttcaaggcaaacagcacctacaaagccaacagagagccttgtaaagaaagagaaacaactccttccacagaaagaagacagagtacaaacagtatccatgcatggcctgatgcaccccaatggtgccgttttcaaggcaaagacatcagcacctccacaagtgttcagcatcactgagcacagtcctctgagtaagagaaaggagccacagtggggcatgaaagagagagcaggacagaagcaggacaggacaggacgtcctcatgtgattctgacaaaaactcatccattcatgccttctctctctcaccatagattctctccttcacaaccaaagcttcctatatcatcaggtgcaggaaaaagcagacttgcaaattcaaatgaaggtattagctcacataaagtaatactaaaagcaaaccaacaaatgccatataaagaggcaaaggacagagtaaaaatagaaggcagggaaggtagaatactccccaaaaggatacatttgagggcagaggcactcccacttgcacttctatgcaatggaaagaactactctttgcacattgaagagcaaggggaaggagtacaggaaagcaaaaaggaacctggagtggttccgaggaaatctgcttcattccctcctcctccattttacctgaattgtgacactagaaggaatgaaaaggaaggcacattaggaaaaacacaattcagttttccaccactaaagattcaggattcatcagattcaggcaaaaaagcatatactgagtcactgcatggttacacattaagcaactcaaaaggaccagtgcaacccacagcacagggagaagagaaaggtggactcagaatagatatggaagacaaaatgctccccaaatgtacagacctgaaagcaaagcaattactactctcagatatactcaataccaaaaaattgcagtggaaaagtaaagaacaaaagagaaagattcaggaagataaaaataaacaagttaaaggactgccaagcattaatacttctttacttactccaccatatcttaagtttgatacaacagaaggacaggagaacgtgataagaattgcaaaagtgtctctcccacagtcacggtccaaggaatcatcagatgcagggagaatagcatgtccagaagcaacccatggagaactttcaagtgatgtaaagcaattaaaagcacacctgctacagaaagaagagaaggatagagaaaaagttgcggatatgaccagtgtactggatcccaacaaaatgtatttgaaggcaaagaaatcgcctgtcttacatacgcacagtttcagtgatcttcagtggaaaactagagagcaagaggaggaaaaggtccagaaagttaaaagtgggccaggtgtcatgttgtctaagagtccttctagatcctccccacttcaccttaatgtgaatacagggtttcaggaggaaagcataccaatattaacaagaccctcttttcccctagtaaaactccaggtatcaccagatactgagggaggcacatgtataaggccaattgctggtgatattttaatctatctacaaaaaggaaaacatgtgtcacagaacaaggaagaggatgacgtgcaaatagtaagcatcttaatattccccaaacatcaggaagagaaggtgcaggaatgtgaaggtgaaccaggtgtggttctgaccaaatctacttcattgccatctctatctcaactagaattggataaagaaacacatttaggtaatgaaatgctaagacttaaaagacctattttgcggagaatatcacacataggggagactgtacatagagagtccgtcgttggtgatatcccaaaagatgttaaaaatgaaaagcaacatatccctcaaaaagaagagaggaaccaaaaaaaaataatcgatatgagaggcacagatataactttgaagtcaaagaagtcacctcgttcctgtatgctccacagaacagaactgcatgtgaacattggagggcaaggacgaaaggaacatgaaggtcaagataaaccaccaggtatgattcaaagaaaaatgtgcatactcttttccaaacctttgccatctaaccttaaactggagagagctacgcatgcagatgaagaaaggcttggaggtaagacatcctttgtacttccactaatgccatcagcattaccagatacagagaaaacagcagatgcagaggcaaggagtggtgatgtaagaaaaggaaaaccacataggtcacagaaagaaaacaggcatgaagtgaaaacgatagatatgaggttcaggatacactgccaagaggcaaggatttcaccaatgtcacatatccttaatgcaaaggaattagtgttgaatattaacaaactggagaaaaaagtacacaaagataaagatgaagcatgtgtggttctgtcaaggacttttctttctataccgtcagcacctcctctttatctggattcagggaacaaaacagacaaagacactccaggaattacaggatcatcttgtccacagcgaactctccatgtaccctcaaatacccagaaaataacaaatagagactcagttgaaggcgttgataaaaacgttgttaagcaagcagaacagtatgtgccccgcccagaggcagagcaacagttgacctcaaacttcatgatcagcgtccagcaaaggaaccaaccttcacgagtcaggtcagaagaagatttgaatcagttagttttaaactcacgggatgaggacatttatttcacagggtttggtaccataagaagtgggaaaaggccggaatggctctttacagggaaaaaggctcagcctgtaaaatacaaaacagaaactttaactgcgtttctttcctatcccacaatggatgcaactaaaatgggaggtctggaagaagacactgaaataatggataacttaaaccataaaatcagtcctaaggcttcagtttcactgataaggaaaatatctaaggaactgtatgtcacacttggcacccctgcaaattcaaaaggattttctgtttcagagagatacgctcaccagcaagaaacttcatcgaaagtatctccagaacttgcaggttcatgtaaatttgataagccaaaggaagatggacaaagtaatgatagaatcagcaaaatgttttctcccaaagtgttagcaccacagacaaagggatcactcaaaaaaataagtatcgtcaccaactggaatgccccccaaaatatagaagaacaagatattgtcatgaaaaagcaagtgatccgacggtgtgaacatgggcacaagaccaggacgaacactatcctttctaagtttccccttcaaagtggaaagcagaagacaccatcggaaacagatgtggacaagaaaacaacagcgcacctcagcctacagatgctaccaggaatacacatggatatgacagagattgaccctgcaaaagggggaaggaagcaggcattgctcatttcagaacaagaggaaggtgttctggaatttcttccgaagtccctattccctccctggacttttcaatttcaatcaggggatctggaggaaaaacatcaaacagacgcaaacaccaatataaatctagagcagaaaaaattagaaatggacaatgatagtactgtgaatcagaaagaagggaaattaaaaataggcacaaacagagctttacatctgcaagaagagaaaacagagatgcacaaggccaggactgccaatctggagaaggagagaggaagaatggacacaagcagtagtgcacacccgcatcttctatctctaaaggcagaggaatctcaaatgaagactcaagtcatcactcatagggagaacagccgcctaatcatgcaaaagcagaaaaaagaactagaagcatctaatgcaaaacaaagcattcaactacaaaaattatttcaaagaaatgttctggattcattttattcatatgttcctctttctcccaaacgtaaagatcagaaaggcagattaacaataagagatctgaaaagagaattgagcaccaaatatttaactatgaaaatccagaatcacccaattccacagatgcttaatatcacggggcgtggtacaccaagcaatagaaagaaattagagtatgatgttaagttaaagaacatagcttcgtggagtaaagatgtctcaggaatatttatcagaagtctttctatttccatcatgcgttcacctcacactgaccctaagacaaacctagaaagagaaaagagaatctgtcttcctaaattccaggaaaaatcaccaaacactagtgaaatgtctaagagagacactttaacaattgtaaaaggggaacagaattttacaaacacagttccacaagatccccagccctttgcagtggacaaacaacaaatgcagaaacttcctaatgtcaaatcagaagcaaacctcagaagtgaaatgaataaaaaatacttaaaggcacaaacaaaagaacggattgttccagagcatgatgtctcaaggatcattaaaaaaccagacttacgtatcatcgagcaggaagaaaagattctaaaacgcattctgacacccacagagtgtccatctatgcttgaagatccaaagttacccaagcaaagggatcagagtgaaccagtatgggacatgaccacacaaaaggttcagcagcaaaaagctttcccaggaactgtgcccataccgcctcaagttaaaagtagcgaagtcaaaatagttgcagacagtacaaatgcagaacatttacttcccatttgtgaagcaaccaaagctatctctgagtcccaggttaaaaatatgatccaagacaaagtttcttctgataaactagataacatacaagcctataagcctgacgacttgaagtcaccaccttttccagagggtccagatacaatatcaacagcaatatatcccaaaacgcagcacaaatcccttttagaacagtttactcccaaagaaaaaaataagcttactagtcatttagagtcaaaagcacttgaaatacaactgaatctgataccagagatggcaaggaaatctttacaaatgttcaacttttatccaaaagggactatttcaaaagataacagttggaggttctattctagacataaaacaatgaactttatgtctctagaagggactgataccatagaacctaactcaaaacataaacaccaaaaggattcacctcttgccagcaatatgaagacactgattgttgatgtttcaagtgacagtgaggagacaatcacaaagctacagagtattaataagctagaaaatggaacatctgcagtgacttctgctagtgagatgctattgcctcataccctccaaaaccactcagtaaaagaaaaaggcaaactcctcatgcacttttctgtgaaaacattggagatacaaatgaaagcctttcccagaattgtaagagaatcttatgcaatgaccagtgctcatgagagaaagaaacccttatctaactgtattcatcctggtttcacaggaccaaaacgacaaaacagaattttgttactttctgaggagaaatctctccatcaaatagatcttgatttacaatacaaataccttcgttttctcctggggcttcctgttggaagtacgttccctaagccaaatgtacttcccaaacatagtaagttaaacacaattgcagtgtgtaaaaacgtaaatgctggtggacaaagtggtagtctttccattgatacagaactgttagaacaacatatttctttcaaaaagcaaagtccccatgaaaactcatcactcatcagaaaattcccacagccaacccttgtgtgtgcttctgaccgtgatctgcacagcccgaggaagaaagatactcaagttctttcagagtcagaattccatgtgactccagaaaaaaacaaacaatatcatgtatggtttcaagaaagaaatacatgtgaatctgttgatttaaggacccagagaaatgctactggttcagctgtttcatgtgaaactcagatttctgaagattttgttgatattcagacagatattgagagtccagctgacttggacgagtgttcatgtcttgaagtaagtgagagtgaggaatgtgtgtttctggaagccaactcttatttaagtcaggaatcagaaaacattctatttgaattacagacaggcattcctttggaaaatgtctacaaaatcacgactgatttgaaatcattttacagtgaagattcaggttcccattgtactagagagtgcagaaaggaaaccttaattattacaccaccttcctgtaagtcccacaaaagcaggaaatatagatcatcttccaaaatgaaatctcctgactggttgtgtcatagttcatcaaatactgcggaaattcagtctaggtcatctagtgtatcattcagtgaagagaagatttcatggactaccaagagcagaacaagttactcttcagctcccttaactgaatcaaatattaaatcacatcttgcaaaaaaccaaggcaagtctcacaggcacccagaaagccaagaaagaaagaaggccagatctgatttatttaggaagaacagcagtcattgggaccacgattacagttgtacacacagcaaagggaaacgtgacagaaagaagagagtgtatgattatgagtcagaaagattggattgtttccaaagcaaacataaatcagcatcaaaacctcatcatgacgatatcaacttctattctgaaagaaaacaaaaccggccctttttttttgcctgtgtaccggcagactcactggaggttatacccaaaaccattcgctggactattccccctgaaaccttaaggaaaagaaacttcagaattcccctagtggcaaagatttcaagttcttggaatatatggagttcctccaaaaagttgttggggtcgctctcggggtcccttactaccgtttttcatagctgacattaccatagctaaactcctctgaagtggacagctggtcgctattgtgatattctgtgaaaaatacaatcatataacatcc

SEQ ID NO: 120886 - DNA, 708 bp, Homo sapiens
  Payload ID: 3686
  Gene Symbol: CCDC169
  Gene Name: coiled-coil domain containing 169
  Uniprot ID: A6NNP5
  ENST ID: ENST00000239859
  CDS Start-End: 33-677
ggaaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcc

SEQ ID NO: 120887 - DNA, 716 bp, Homo sapiens
  Payload ID: 3686
  Gene Symbol: CCDC169
  Gene Name: coiled-coil domain containing 169
  Uniprot ID: A6NNP5
  ENST ID: ENST00000239860
  CDS Start-End: 210-635
aaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcaggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 120888 - DNA, 624 bp, Homo sapiens
  Payload ID: 3686
  Gene Symbol: CCDC169
  Gene Name: coiled-coil domain containing 169
  Uniprot ID: A6NNP5
  ENST ID: ENST00000379862
  CDS Start-End: 255-593
ggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcc

SEQ ID NO: 120889 - DNA, 5944 bp, Homo sapiens
  Payload ID: 3686
  Gene Symbol: CCDC169
  Gene Name: coiled-coil domain containing 169
  Uniprot ID: A6NNP5
  ENST ID: ENST00000379864
  CDS Start-End: 332-751
gttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgtacagaaaagattgggacccactctgctggtttagtgtggcttcatctctcaaactgaatgaaacttcttccaactctcctcgagctgacttcaccttggtctttttatttttacttttttacagtgagagataaggattttattttttcttcgttgttatttatttcaatttttattttagattcagaggtacctgtgcaggtttgctatcgtggtatattgtataatgctgagatttggggcacaaataatcccatcacccagggactgagcatagtagccgaaagttatttgtcaatgtttgctctcctttcttcctccaccctctagtggtccccagtgtctattgttgctgtctttatgtccatgagtacccagtgtttggctatcacttgtaagcgagaacatgcagtatttggtttcctgcttctgtgttaatttgcataggaaaatggcctccagctgcatccatattgttacaaaggacatgatttcatttcttttatgactgtgtagtattccatggtgtgtatcaggagtccccagcctctggccgtggactgttacccatccatggcctgttaggaattgggctgcccagcaggaggtgagctgcaggtgagcaagcattaccacctgaactccacctcctgtcagatcagcagcagcattaaatcctcataggagcacgaactcttgtgaattgtgcatgtggaggatctaggttgcatactccttatgagactctaatgccagatgagaatttaactaatgattaatctgaaacagtttcatcccaaaaccatcccctccccaaaatacagtccgtggaaaaattgttttccatgaaaccagcccttggtgtcaaaagggttgggaactgctggtgtatatgtagcacattttctttactcagtccactgttgatgggcacctaggctgattctgtatctttactattgtgaatagtgctgcgatgaacatgcaagtgcatctgtctttttagtagaaagatttgtgtttttttggatatatacccagtaataagattgctgggtcaaatggtagttttaagttctttaagaaatcttcagactgctttccacagtggctgaactaattcacattcccaccaacagtgtctaagtgttcccttttctccacagtctcaccagcatctgttgcttttttacttttcaataatagccattcagactggtgttagatggcatcttatggtggttttgatttgcatttctctgatgattagtgatgtagagcatttttttcatgtttgttggccacttgtatgtcttcttttgataagtgtctgttcgtgtcttttgcccattttttttaatggggttattttttgcttgctgagttgtttcagtttcttacagtttctggatattagacctttgtcagatgcatagttcatggatattttctcccattctgtaggttttctgtttactccatcgctagtttcttttgctgtgcataagctctttaattaggtcccatttgtcagtttttgttttggttgcaattgcttttgcgacttactcataaattcttttgcaaggccgacatccagaatggtgtttccaggggccaggcctagtagttcatgcctgtaatcccaacactttggaaggccaaggcatgaggattgcttgagcccaggagtttgagaccagcctgggcaacatagtgagactgccatctctacaaaaagtaaaaaattagccaggcatggtggtgcatgcctatggtctcagctgcttgggaggctgaggtgggaggatcacttgagcctggcaagtcaaggctgcagtgagctgtgatcatgccactacacttaaggctaggcaactgaatgaaaccctgtctcaaaaaaaaaaaaagtgtttcctaggtttcttctaggattcttatagtttgagggcttacatttaaatctttaattcatcttgaggtaatttttgcatatggtgaaaggtaggggtccagtttcatccttctgtatatggctagccagctattccagcaccatttgttgaatagggagtcctttccttattgcctatttttgttgactgttgaagatcagatggctgtaggtatgtggcttttttttcctgggttctttattctgttccattggtctctgtgtctgtttttgtgccagtaccatgctgttttgattactgtagctttacagtatagtttgaagtctggtaatgtgttgccactggctttttcctttttgattaagattgctctggctattcgggctcctttttacttccacatgaattttagaatagtttttctagttctgtgaaaaatgatgttagtagtttgataggaatagcattgaatctgtagattgctttgggcagtatgactattttaacaatattgattcttccaccccatgaatatggaatgttttaccatttgtttatgttgtctgatttcttttggtggtgttttatagttctccttatagagatctttcacctccttggttagatatattcctaggggtttttgtgtatgtctttgtgtatgtggctattgtagattggattgcattctcgatttggctcttagcttgaatgttgttggtgtatagaaatgttattgattttttgtacattgattttgtatcctgaaactttaccgaagttgtttatcaattccaggacccttttggcagagtctgtagggttttctatgtatagggtcatattatccttgaagagagatagtttgaattcttttcatatgtagatgccttttttttttctttctcttgtctgattgctctggctagcacttccagtactatgttgaatagaaaatagctattttggggagaattttccaaccaagatgtcaaaacaataatgatgagagcattacatgctaattcccaatattttcctttgacttatttaaatttaaataatccaatttttttacttaatgaccttgtggagatatttataaaacaccttttgatttttgactggggctggatttttaaaaaatttataaagagctatatagtattgatttcaaataaattattcctaccttttcttcatctgaattagttttagcatgtataggagattccaaagcagagttacctatatcaattttagtactattattttcatattctactggataagaaattacttatttggaactaagaattattcttgcaacagaagcttatcagtaacactatttgattgctttttgctgtgtgcacaggtgaggacctgtctagacttctatactatgtacattgtattaattttgttcataaattaggtaattgagttatagatactaatttaatatttaaaaaatttagattgttgattttaaatatcagaataaccaaactgtaacaacagtgctgggattttggtatttaaaaagggcagagtataccagaatattgaaaactggtattgaaatcactacatataattgaattatgaaaaagtacctttaagataataaagcactacataaatatgagctcatatcatatatttgacagtagggcattatttttacaggttaacattcaattaatctgactatgaattagaaaaatcttgaatttgtagagttcatttaactttattaaagcaatttgccaactcagctacagaaatacagaaaatattactatctggagaactacccagtcgtaagtttatcatcgttgaaattgcttaagcagagattaggtgaccattcctcaggaatagtatacgaaggattcctgcagtggtggaggtgtgtatttgattgctgtcagtgtgccttctgatactaacattctgtaattccctgctcatttatcacacaacaaaacatgagacaaaaataactccataaaatatatgttgattataccatataggttgtatacatatagactataaatatgagctttcaaaaacgttttgccattagctaataactaacaaaatcagttttattagggtggttttgtgtttatattgcatggtgttcaatgagcttatatctgtagttttcatcaaatgtggaaaattttgggccatttttgtattatttttctgccctttcctgtcctcctgggactttaattacagcctgttgtaaaccacttgatattgttccttttggttctttttttatatcttctgtcactgtatttatgttttcctttaagtaattggataggcatataatgacttttagcatacttacacagtatctttttcatttctcagtctgtttctggtgactgatttttctcctggtttcgggtttcattttctgcttcttgtaatatctactaattttatattagatgccaggcattgatgatttcacattgttggttatagatttattcttataggcagttaaattaattgcagttcagtttcttcttttcaagcctttgttagggtaagtatagagtgagcttcaccccacagagagtttaacaccatttctaaggcatagctattgtgggatcactagaaaattctgtgagtgatcagctgggacactcaacactggctagttggacctcagatgcctcacaggcctgtgtggcactctgcttgacctcgtagagttttgctctaggcttacatgtcttaatatccagccacctctcaaggggctcctatgcagatttctggaattctgtttttacatatctgttagctctctggtactctgctctgcaacttcagccacttcagcctccctgaactccagcctctgtcttctcaactacatgaaaccaccatgctttgtttgggatcccctaccctgctctgaggtctgtgcctgcaggtagaaatctagaatgatggatgggcctcacttcattcctctcaggggtcatagtcttaaggtgcatgtcaatatctgcagttgtttcatatatttttgactaattttctgtttcttcacagtaagaagctaaatctttcccctgttactctcaaagccagaagtaaaggataaagcattaaaataaaagcaaagaaaatattttaaaatctaatataaaaa

SEQ ID NO: 120890 - DNA, 854 bp, Homo sapiens
  Payload ID: 3686
  Gene Symbol: CCDC169
  Gene Name: coiled-coil domain containing 169
  ENST ID: ENST00000506800
  CDS Start-End: 257-532
aaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaacttttaaagtgactaaaagccctaaaggaagaaaataactaaggagccattggtaccctggagcaaaagaacctgagggaaattgatactaggacttgcctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 120891 - DNA, 753 bp, Homo sapiens
  Payload ID: 3686
  Gene Symbol: CCDC169
  Gene Name: coiled-coil domain containing 169
  Uniprot ID: A6NNP5
  ENST ID: ENST00000491049
  CDS Start-End: 253-672
aaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 120892 - DNA, 837 bp, Homo sapiens
  Payload ID: 3686
  Gene Symbol: CCDC169
  Gene Name: coiled-coil domain containing 169
  Uniprot ID: A6NNP5
  ENST ID: ENST00000503173
  CDS Start-End: 31-756
aaagacgcgggaggtctctggcctgacactatgaaggaagagagaaactacaacttcgacggtgtgagcaccaaccgcctgaaacagcagttgctggaagaagtccgcaagaaggatgcagtgcaactctcaatatttgaactaagacacaagattacggaactggaagccaaactcaatactgacaatgaaggtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggtcagctgcttggagacattgggtttcagtgctgcaggtgtggctggaccagagaataggacatgcctcggacaaaaagcactctggcccgcctgcttacatgggtcctcaaccttggctgtgtgtcagactcacctgaagagctaaaagtaaaatactcagacatgtgcaccacccccaggattgtgatctcacatgtatttctttaagcctcccccaggaaattgt

SEQ ID NO: 120893 - DNA, 1088 bp, Homo sapiens
  Payload ID: 3686
  Gene Symbol: CCDC169
  Gene Name: coiled-coil domain containing 169
  Uniprot ID: A6NNP5
  ENST ID: ENST00000510088
  CDS Start-End: 332-670
gttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcagatagactatcttctattcgtgtctatgaacgaatgccagtggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaactggaagatataatccagctaagcagaagacagtgagtgccaagagaggaccagtaaaaaagattacaagaccaaaccatcttccagaactccatccatgattccagaactggatggatttctatttcttcctttttttttccatttataatattcaagttataaagttaatggtcagcacatttcttcagggaataaaatagataagaactgccacatttttctttagttccttttccagacgtgtgttcctttgtctgcataaaagtaattttctccagtgaccctaaactatgtaatagaagtgcttgagagttttaaaatatcctagggaatctgaaggctggcatcattacacttgctttcaataatatacccatgatctgctctgatagtaacgttgctattctatttggtttctagttgactgttagcaaaaagtgtgtattcataaaacctttttgccattttgggctggatcttgctcagttttttaaattgcaggtttaaacaaagccg

SEQ ID NO: 120894 - DNA, 1873 bp, Homo sapiens
  Payload ID: 3687
  Gene Symbol: CCDC17
  Gene Name: coiled-coil domain containing 17
  ENST ID: ENST00000372044
  CDS Start-End: 93-272
ggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcgaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagtccttaacttttctgtacctcttctgtttttgtaaaacagattaaggattaaatgagtttgtcaggta

SEQ ID NO: 120895 - DNA, 2216 bp, Homo sapiens
  Payload ID: 3687
  Gene Symbol: CCDC17
  Gene Name: coiled-coil domain containing 17
  Uniprot ID: Q96LX7
  ENST ID: ENST00000421127
  CDS Start-End: 145-1986
aaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggttgtgccacaagaacaccagggcgtgccacaagaaccccagggcctcccagaccagcaggccagtagatctgctctaaagaggttaacagaggaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagtccttaacttttctgtacctcttctgtttttgtaaaacagattaaggattaaatgagtttgtcaggt

SEQ ID NO: 120896 - DNA, 443 bp, Homo sapiens
  Payload ID: 3687
  Gene Symbol: CCDC17
  Gene Name: coiled-coil domain containing 17
  Uniprot ID: Q96LX7
  ENST ID: ENST00000445048
  CDS Start-End: 59-391
ccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggccta

SEQ ID NO: 120897 - DNA, 2181 bp, Homo sapiens
  Payload ID: 3687
  Gene Symbol: CCDC17
  Gene Name: coiled-coil domain containing 17
  Uniprot ID: Q96LX7
  ENST ID: ENST00000528266
  CDS Start-End: 149-2017
aaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggttgtgccacaagaacaccagggcgtgccacaagaaccccagggcctcccagaccagcaggccagtagatctgctctaaagaggttaacagaggaggtgcagtggctgcggctatccctacaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgtccagcacatcttcactggaagccagcttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagt

SEQ ID NO: 120898 - DNA, 2038 bp, Homo sapiens
  Payload ID: 3687
  Gene Symbol: CCDC17
  Gene Name: coiled-coil domain containing 17
  ENST ID: ENST00000479529
  CDS Start-End: 149-1843
aaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggtgcagtggctgcggctatccctacaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgagggcccagctgcagctagggacaccacagctacacataccggtgtggctggtatggctaacggccagcctttattgaccactgtgtgccagtcattaccaatgctttcttgtttgatcctcacatctctatgaagtcctactatgtaacagataaggaaatcaaagcaggagcaggttaacttggttcacagtgtccagcacatcttcactggaagccagcttcctcacccccgcagttggctttgctgatcccccacctcgtacagaagag

SEQ ID NO: 120899 - DNA, 5293 bp, Homo sapiens
  Payload ID: 3688
  Gene Symbol: CCDC170
  Gene Name: coiled-coil domain containing 170
  Uniprot ID: Q8IYT3
  ENST ID: ENST00000239374
  CDS Start-End: 100-2247
gttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtacttctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgcca

SEQ ID NO: 120900 - DNA, 6512 bp, Homo sapiens
  Payload ID: 3689
  Gene Symbol: CCDC171
  Gene Name: coiled-coil domain containing 171
  Uniprot ID: Q6TFL3
  ENST ID: ENST00000380701
  CDS Start-End: 329-4309
tccggaagtggcagttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgagacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttattagaaaaagagtatttctccaaaaataagaaactaaatgaagacatcgaggaacagaagaaagtaattatagacctttcaaagagactccagtataatgaaaaaagttgcagtgaattacaggaagaactagtaatggctaagaagcaccaggccttcctagtagagacatgtgaaaataacgtgaaagaattggaatcgatcttggacagctttactgtgtcgggccagtggacatcaggcatccacaaggacaaagataaacctcccagcttctctgttgtccttgagagattgaggcgtaccttgacagattaccagaacaagctggaagatgcatctaatgaggaaaaggcatgtaatgaacttgattctacgaaacagaagatagactctcacactaaaaatataaaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcaataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaattttcttatcagttgacttttgtttcagcagaagtggcagtggatttaaaaaatttgtgcgctatcttgatgtattctggtagctctgtctccttgaataaggaaatagccaacttttttctctccaagttttatttgttatcacagttgctcatttttatgtaacatatttttaaatgttaaggaatgacacattttgggtaatttccctcagacttaaaaaaatcaataagccattttagtctctatctatcaaagttgtttcatacttgtctattttaaagcaggactgcaatgctttaataggattgagagagctatttgaaatgtatgccaatgattcctgtcatttcatggcagcccggccatggttcactgagccccctcttctctcttgtcagctcaactgaagacaagcatttagttgcaaactttaagcaggttgtgcaaaacagaaatgatgtgactgcttctcctcctgcacaataatgtcactcctggtcaatgtgagaaggtcaggttgctccttgtaaagctacatgataccacttgcccatttgaacaagttaagttaactgctgaatctggtccctgaaggcactgaaaactcattcttttagcaagtctgcatttgataagaaagtagagcaattgtgctggaggatttctgtggtatgtttaggcacttcataaggacagttcccacactaggatagcaggtaatatatttagtataagctgaaaaacttcaaggtaatggctgttttgaccttcaaaatagactccttttttgtttttgttgttggtaggacccaagagtgacacccatctttgatgctgacagaatttaaaacaaggccattgccctgcattttctgccttgtagcacacaaaagtaaaattgtatgtcaggccgagatgtcggggagctgacaagatgccccagtgacatttcagctagaaagagcaagtgtcttgcaaccaagtggtcaaatatcaaataataggtcaagcaggaaggagctgagttctaaccacaaagaggtttctggtaacttacttgacaagcttttgggtgctttgtggcttgacaaagtgatgttctgttgggtatcgctagacagactgttctttatcgccttcagaagatcagacattgacattgattaaactctttaacccttaaaggttaaatccttgcagtttgcatcatggtaagtgaagaacaaaagaatatttgtagtaagaatttgtttttgtattaatcatttaactccctagtgctattaacttctgatgtgaactatagcttttgacaaagagtcttgatacataatctattttttatattatttttcattatggaatctttcattatggatacattagagtataacagtatgtattacagaagtttttttgtcttatctttacagtgacatttgattcaaattacccaactgctgagaatttttttattggccttggtaaataagattttatactaactatttattagtagccaaattagccaagtgatttatgccatctgagggaacacagcagtattactgtcgtactgtgtaacacatcctattcttgtaatactgaaccactataattagctttatataaaactttagaaagcttatatggagtaaaattatatctttaaccaaatttctcttaattctttccttggaattatttttaatatgacctgtgtaacatgacctgtatgaaattcaacttgcaaatttattataacatggaagtgctatttattgtttttatacagatcatataatttctgcacatttcagaacacctttctctgctgttccaaacaatgattaggatattgttcatacagaaattgatagacaattttttagttcatgtgatatcactgagcttacaattctcactagagaagaacaaggttactatatgtaacctctatgtctaagtgtttgtgtgtgtgtatgcttgtgttgaatctgttttcagatcctactgattttagaggaacaagcagctttgtaaaatgtgccttggaaaggccttggtcttcttgccttgattttataatctgttaatgggataactccaaaaataaatgtgtatgtgtctccatata

SEQ ID NO: 120901 - DNA, 2181 bp, Homo sapiens
  Payload ID: 3689
  Gene Symbol: CCDC171
  Gene Name: coiled-coil domain containing 171
  ENST ID: ENST00000432954
  CDS Start-End: 1-773
ttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattgcactaactggagagaatgaaagcctcaaagtattgtgaataatttaaaggagatgcaaatagatgtttcttcatttttcttctatcatgtaacagtatactttacaaaatattgtttttttctttaaagcctagaactagcctattaaaataatccagaaaagtgtttttaccaaggaaaaatgtgttttatggcaaagtacagtattaaaagaaaatactttcctatcagcagaggacaataagacactaggctgttacctctttaagcaagtctcaatttgttgcttttattgtttgaaaataagtaattttagaaaaaaaataaaataataaatcactttagttgtaaacatcaaaagagatacctgaaatatctcaatattaattccaaaatatatccaacatttcttatgaagtaatttaatttcagcaaagcttaaacttatctgtgttttctattgaagagtattttaccctttaatatttagttttagtgaacattgtaagatgtgcaaattgggtcatttcatttataaaacttaaaatatcaaatcataagaactcaaataactttaaagtacactaataaacttatttttagaaacattcattttcggatgctgtaggtatccttctattttatgtcactattgtattaatattattgtgatcaattttttccttaaggttatttttcttaatctgacaaaatgaaattcagtgtgtccttttaatgcccaaaaccttcattaaaaaaagaaaactatcaacattatgtaaattataggaagcatgatatttcaaaagagactgtccttgttcaatagcactctattttttagtgtatttaaaaggagaaatatctcttaaaacttagtgtgtctttcacatgttgagatttaaaataatctttttcattttagtttatgaccctgtggaattttaattttatagaaaattaatgtcagtgtgtgtgtggagcaatgttaattttttatatgctccatatcctaatttaatttgttattagtaccaaattaatgctctacaaggaaaaaaatactcattgcttctttcattagattgtccaatatgtctaaaatatatataattataaaagtaagcataaaatatttttcttctctgttatagggtagattgctgtactgttatttaagatgagatttaaaatgtgtattttaaatttgattgtcagtatttatgaattcatcattactatgaatacagtctgatttgagatttttctagtggttgtaaaataatcctttacttggctatttcaattcagaatctcacaaggcttagtatttgtcgtaatttacaagtaaagacttcctcaaaact

SEQ ID NO: 120902 - DNA, 2628 bp, Homo sapiens
  Payload ID: 3689
  Gene Symbol: CCDC171
  Gene Name: coiled-coil domain containing 171
  ENST ID: ENST00000449575
  CDS Start-End: 1-1409
cctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtgcagtggtgtgatcatagctcactgcagtctcaaatgccagggctcaagcaatcttcctgcctcagcctgctgagtacctaggaccacaggtgcgcaccaccatacccagctacttggacaaaaaacagtgtttgatggactgcctaggtgaagacctggaaaaggaagggttatctacaaatgaactgatgaagttcttcaaattgatgccgcttatataaactgaccccgatttgccctattctgcatgacaacttaagtgacagcagttagaagaaaatacagcaatgaatatgcaacttaaggattaaggaagatgcagtaaatcagtctaaagctaagtacaatgataatttcttgtaataattccacagatgccttacatttgttaaacagactgttattactctcaaatactcaaatatatgttttcattatatacatgtatttgaattgaagaagagaactaaaagttattccaacagagatcctaattcttttccctcttatttaaacttggaattatcaaaatcacagttttaaaaatattttatttaggatatccacatgcaaaagaatgaaattggaccttggtcttacaacatgcacaataatcaactcaaaatggagtacacaatgttagaaagacctaatgccataaaacaaaggaaacaacaaaatggaaaggcaacttgtggaataggaaaaactatttataaactgtatatccagtaaggagtttaatatccaaaatatataaggaactcatacaacacaataacttttttaaaaaatgggcaaaggacctaaaaagacatttttccaaagaacacatgcaagtggccaataagtaaaaaggtgttcaacaccgctaaccattagggaaatgaaaatcaaaaccacaatgagatatcacatcacaactgttaggatggctattaccagaaagtcaaaagacaacaagtgttggcaaggatgtagagaaaagcgaacctttgtgcactattggtggaaatgtaaattggtatagctattatggaaaacagtatggaatttcctcaaaaaataaaaatagaactaccatatgatccagcaatcctacttctgggtatacatcaaaaggaaatgaaaccgttgtcttgaagacatgtctacacttccatgttcattgtagcattattcacaatagccaagatatagaaacaacctaagtgtcctctgatgaatgaatggacagaggaaatgtttatacacacacacacacacacacacacacacacccagaggaaaattcagcttt

SEQ ID NO: 120903 - DNA, 4017 bp, Homo sapiens
  Payload ID: 3689
  Gene Symbol: CCDC171
  Gene Name: coiled-coil domain containing 171
  ENST ID: ENST00000535968
  CDS Start-End: 176-1129
gtccctcagcgaaggcgcgctgcttggcgggcgggctcttccaatccgagccagcgttctcggaacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggttgaagattgcctcattggatgtaaaacaaatacttaaaaatgaaacagagttggatattactgataatctcaggaagaaactccattgggctaaaaaagaaaagttagaaataacaaccaaacacaatgcagagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtgcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggaagcgttggaaaaacatcaacgggagaagaatgagatggagtctcatatcagggagacagcattggaggagtttagattacaagaagaacaatgggaagcagaaagaagagaattacaatttatagtacaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggcaactactctaagagtgaggaaattagaagaaaacattgaagcagaaagagcagcgcatttggaatcaaaatttaattctgaaattattcaggtaaaatgtaaacaaatattttggcctgcattttcttaatttgtgttataacagctgggaaaaacagcactgtgttcagagaacgaaggtgtgcattgagaatgggtaacatattgttatgacactcattattgtatataaggttaggatacagttgagatatgctaccttagtggaggagttggcacactatagcctacaggccaggtctcacccactgtctgttcttgtgaagttttgtcttgtccatagctacttttgtggcagagtggagtagttgtgacagagaacttacctggcagtctgcaaagaaatttgcagattggagtgttcttttacggctgtgggatggatttctttttgagaacgttgaaaaaatgtgcatgttatttattgagtgcatatcctatgcatatcactgtattaagagctgaaggtgtaaagatgaatgagctccttttgtaacttacattttgttgtcagagatactatatatctatctccagatatatagatgcttacatagaagtacaaaatactgaaatacaatgggaatataataaagaaaaggattaaatctgggaggggaattaaatggaggcctcctaaggaaattatcctttttgctatgctttagagaatgagaaggaatttctaagagaagtgagagcagggcattttattaggggttggcacactactgcccatgggccaagtctgacctgcagcctttttctgtaaagttttattagaagatagccatgcccatttgtttacatattgtttatgggtgcttgtcgagacagaccttatggtccacaaaaactgaaatatttactctgtggccctttacagaaaatgtttactgaccactgttctgaacaactgcttggataaagccactaaataaaatgtacttgtttatttttgaggaatacttgcagtgttgagtggtagagcttagggaaaagtttggagataatggtgggaaggcatgatgaagactaattatggaagtcctttttcgtgctaagaaacttagacttattttgaaagcaatggaaagccactgcagcttttgggacagacagatatgaaatctaagtttaggaaaataactctggtgccatattggtagataaaggaagggagtgaagataggaggctgggtgaagagatgatgaacacctgaatcaagacaacgactgtagcaatggaaaagagggctcctgtggcagaataacagtccctcaaagatgtccacatctgcccttatcctcagaacctgtgaatatgttaccttacatggcaaatgggactttgcagatgtgatttatttgaggatcttgagatgggagtttgtcccagtttatctagttgagactgatgtaatcataagagtccttataacagggaggcaggagggtcacagtcagaggcagagatgtgatgacagaagcagaggtcagagtaggtcaccatgaacccaggaatgtgggtggcctccagaagttagaaaaggcaagacaagatttcttccctagagtctccagaaggaatggagtcttgctgacacgtgactttagccccagaagacccatttcagaattttgacctccacaactgtaagataatacatttatgttgttttaaattgccaatttgtggtaattggtaatagcagtgattggaaaggtacaggggacaaactgagaatgcatgattttaggtaactaatttgcagtgtgaggggagggaaggagcaatagaagagaacaccaaggtttgcagtatgtgtgaaagtgggcagatgcagttgactgtcaaactctgaagtctgaagagagacaatggtaagttttgaacatgttgactttgaggagcagtttaagaggttcatagtgccctttgaggatatggtcatgcaaagttacctgaacaatgtacatttactcttgacatcctgctttttgtgaacagatcctttctttatattctctcaagcaactgccggtagcttatcttggatcagccagtttcccaggtgttaggaaagttaaggaaattacataggaggagatttgttggacctgctactttcttgattttaatattttatagacagttatgacttttcgcttaaatgttttctcagcatttgataatatgctttaaaatctaataaatatggtatttgttatgcttctgttaaagagattaactttaatgaagattgtatacctataatagtatttttgtttgcttaaatctaggaaggtagaaagtatctttatgaacttagattctcagtataaactgttaagatgttcttatttcatgttatttagctggtcagttattacatttgagcactactttgtgaacaaatgtaatagactgtatgaaaataaaatatatgcacttatttccagaagaaaaagtagttttaagcttatttggctttagcaagtttgaaaatcatctcactttatttgtgctcttgaatttcatatcaagtaggatggtgggattgccaaaatcagtaaatgaaaagtagctataagcagatagattaaaactagtttagactaaaaaagttattgccttgatttaggtgtttattatcttttcacccaacctcctatcaccactccgttactttatttgccaatgttagttaccagaattatttttctaaaacttagatttgatatctacatcaaaggctacttatattaaaagctactgctttcaatatgtctaaattacttaatttaatttacatttttaaagacttacacttttttcctatcttgttttaattaatgcaatttatagtgttttaccttattgtttaaagaactcccaatgtaagatacaactgtatttgtaaagatttggtattaaaatttatgtttttacttttg

SEQ ID NO: 120904 - DNA, 1699 bp, Homo sapiens
  Payload ID: 3690
  Gene Symbol: CCDC172
  Gene Name: coiled-coil domain containing 172
  Uniprot ID: P0C7W6
  ENST ID: ENST00000333254
  CDS Start-End: 252-1028
ggcaaggcccgacctgaagcactggctccagccttagggaaggttttggccgtgggttttgttggcacgtaccattttgctgaaagacagagcaccttgaggacgttatccctaaaatgagagaggactgggattgaaaggctgactacagaaatggctgctgcccagacgccctcaaaagccaaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaagtaaggtcggaaataaccagatgtcgtgaaaaaattaagaaagcaacggaggagctgaatgaagagaaaatcaagctggaatctaaggttcaacagttttttgaaaaatccttcttcttacagcttttgaaagctcatgaaaatgctttagaaaaacagtacagtgaaattacaaaccataggaatatgcttcttcaaacctttgaggctataaagaaacaaatgatagaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtgaaatgaagtcaatggaacatgatagtagccagttaaatgaacttcaaaaacaaaagagtgaattgatacaagaattatttactctccaaagaaaacttaaagtttttgaagatgaagagaatgaatccatttgtactaccaaatatctagaggcagaaaaaataaaaatcagtgaaaagcctcaaaatgatacagaatgcttaagacttaaaaaagaattagaactttataaggaagatgacatggaaagtgtttatgaagctctccaaacagaaatagaatttttggagttgacattggcacagaaagatcttcaggaaagcaaataacttacagagaattgatcagccatctgagatttgatcagaatatctgagaatcaaatctttgtgatagatatatgaatggtacccgttacaacggatccttgtgggaaatatggggtttaaaatattcaaattgttattatctagaaatgatgtgttagccctttaagataatttttgtcttgttactcaaactttaagagttcttctgtggtttgattttgtttctaaaagaaggaaaaggagaagaagtagataccgtgttcccaggcttcttatatgcccctgaacctcaagctgtcctattctttctaatctatataatatggtttggatctgtgtccatgcccaaatctcatgttgaattgtgatccccactgttggaggtgggtcctgataggaggtgattgggtcatgggggtgggtttctcatgaatagcttagcaccattcttcttggtactgtccttgagttctcctgagagctagttgtttactagtgtatagcacttctccactttgctcctgctgccaccgtatgagatgtctcactccccctttgccttcagtcatgattggaaacttcctgaggcctccctagaagcagaagtcactatgcttcctgtacagcctgcagaaccgtgggacaattaaacttgtgttctttgtaaatta

SEQ ID NO: 120905 - DNA, 2181 bp, Homo sapiens
  Payload ID: 3691
  Gene Symbol: CCDC173
  Gene Name: coiled-coil domain containing 173
  Uniprot ID: Q0VFZ6
  ENST ID: ENST00000447353
  CDS Start-End: 107-1765
acttccggcggcgttgccaagcaaccgcgtggtacgagtaacaactccaccggctggcgtccgcggcgcttggcgccacagtcacttttccagatctaggagcatcatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgaacatatgcaggataaacatattatcaaagctgtagaacagcagcagcaagaggaagaagatgaaaagatgagaaaattcatcaaagcaaaaaagcgtcttatacaaatggggaaagaaaaagaggctgaaacacacaggcttatggagaaacgaagagaaagaatacataacttcctgagtgaactgttgaaagagaaacttgacaatgaagatatgattattgctagagatattgcagaagctgaggctgaatgggaaaaaagagaaagagaaaaagatgaaaaaaacaaagcagaattaaaaacaattgcagaatatcgagccattgtgatgaaaaataaagaggaagaagaaagacaaagaaaaatagaggctaaagaacaattgctggctgtcatgaaagcagatcagattttctgggaacatgaaaaggagaaaaaatgcaaagctgataaagaacatcaagaggttcaagatgcccatattcagcaaatggccaaaaataagtttaatgcaaagcaagcaaaacaagcagaattagattattgcagacttactgaagctcttgtggctgaaaaggagaaagaatttcaggactatgccagagaggtaattgaacttgaatcggaaacaacaaataaatatatttaccctcttgtaaaagctgtacaggaaggacctggaggtggccgtggaccagtgtttgtggacagaggtggattaagacccagctatcaggcaaatgatgttactggagtccagctccctttttataactctcagggaccaaaatataattttcaaaagtcaaagagaaggctaggttttacatggtagaaaaaaattatttttaacattgagaagactaagttgtagcatatatgagcttcaaatataaatggatttcagttaataaagctgttcttcatctaagtacaattatgtctgatttaattgattgttctcagtatttcttttgggtatatataaaaccccaattttgagattcctttttttaactgtggtaaaatacacaagtttactttttaaatgtacattcagtggtattaagtacattcaaaatattgtgtagccatgaccattgtgtagttccagaatttttcagtgctcttactagaaaccccatacccattcattaagcagtcactccccattccccttccccacagctcctggtaactttatctgctttgcctatactgggtattttgaataaacagaatcatactgtg

SEQ ID NO: 120906 - DNA, 569 bp, Homo sapiens
  Payload ID: 3691
  Gene Symbol: CCDC173
  Gene Name: coiled-coil domain containing 173
  ENST ID: ENST00000421028
  CDS Start-End: 94-569
acttttccagatctaggagcatcatggacacctcgtcagagatgctggtacggtttggacggcgctgtggacgggcgaaggaaagtacaggggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaact

SEQ ID NO: 120907 - DNA, 334 bp, Homo sapiens
  Payload ID: 3691
  Gene Symbol: CCDC173
  Gene Name: coiled-coil domain containing 173
  ENST ID: ENST00000419478
  CDS Start-End: 9-334
cagttatcatgccaatatcggaacttctcagacgaatatcacttaaactgttccccaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaa

SEQ ID NO: 120908 - DNA, 2714 bp, Homo sapiens
  Payload ID: 3692
  Gene Symbol: CCDC174
  Gene Name: coiled-coil domain containing 174
  ENST ID: ENST00000303688
  CDS Start-End: 74-1249
gacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaactaa

SEQ ID NO: 120909 - DNA, 2942 bp, Homo sapiens
  Payload ID: 3692
  Gene Symbol: CCDC174
  Gene Name: coiled-coil domain containing 174
  Uniprot ID: Q6PII3
  ENST ID: ENST00000383794
  CDS Start-End: 74-1477
gacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatgggtggattacgtggactctttggggcgttcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgaggcccggcaacttggtgttgggtattttgcctttgcccgagacaaagagttgagaaacaagcagatgaaaaccttagagatgctgcgtgaacagacaacagatcagagaacaaaacgagaaaacataaaggaaaagcgaaaggctatcttagaggcaagacttgccaaacttcgacaaaaaaagatgaaaaaatcaaaagaaggtggaacagaagaagaaaatagagatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaaccaactaa

SEQ ID NO: 120910 - DNA, 2720 bp, Homo sapiens
  Payload ID: 3692
  Gene Symbol: CCDC174
  Gene Name: coiled-coil domain containing 174
  ENST ID: ENST00000611584
  CDS Start-End: 377-1261
gaagacacttccggttgcgacggaggtaggcttacgaggcctgtgtcgggtagaaagggtccttcctggaccgggaccctctgccacgaccatggaccgtaggaaaaagcctttggacgtcacggcctcctcgttggtagatcttaaggctgaactcttccgaaagcaagaagaattcaaacaagaaaaacttctaaaagattctggagtttttggaaaaccaaaaacaactaacaagaaaccaagtatctggagcaaacagaatgtaggcgtttcaaatcgagctgagaaggatgctgaacagaagattgaagaacagaagactttagacaaagcaagggaaaaattggaagaaaaagccaaattatatgaaaaaatgactaaaggagactttatagatgaagaagtagaggatatgtaccttgtggatttcacacagaagatcatagacaagcgcaaagaaatggaggcatctggtgcccatagagattctcaaaaggcaggagaaacgacgatgaggaaaaccttcctggggagagatccctcctccccaagaccccaggttagttcagggtggattacgtggactctttggggctcccggcgctgtatgagaaaggatttgccagatctgctggagatggataaaaatcttcaggggagactttttattagtcctgctaatgaaaaaaccctattatctgaagatatgagaaaagaacttcagcgccagcaatgggaggaagaagaaagagaggccctgaagaggcccatggggcccgtacattatgaagacattcgggaaaatgatggagatgttattgggcctttgccaccggagccagaggctgtgccaaccccacgtcctgctgcccagagtagcaaagtagaagtcattgtccaggagaggaaggacaccaagcctggagtgccacacatccgggagtgggaccgcggaaaagaattttcctttggatactggtcgaagaggcagtcagatctccgggctgagagagatcctgagtttgccccgccgtcagattactttgtgggtcagaagagaactggtttttccagcagccaggcatggagcagacctgggccagcacagagtgacccagggcagtgccctgaccagagccacggacctagccctgaacatacgtcacccactcctgcccccgacaacccaccacaagcccccacagttactttcaaaactctggatgacatgatttcctattacaaacaagtgacatgatctttcaaagcacgctgacttgggtttgtactttgacagtgcctttctctcccagagggagaaataactttaggaactgaattgtacctttgtcctgtcctttccctaggaggcacagacttcgggttggatttgtcagcaaggaggaaagttatggaaactttggccacttggctgttcattttattctaagtgggatagggacatacctacctggatttacatgtgagctgcgatagaatagaagtatttattctgtaaaattagacactgagatgtgcttataaccctgtttcatatctactcccacgacttactcatatttaagggttcttttccattccttttgcaaatccgagcatgcaggtgtctttattccaagggttcagcttccagatcagccgatggaccataggtcacgaggaatttctccctgtcaagcagtggaaaactgcatgggaggcaaaatgctctgttctccaagaggacccggaagtaatcacataggaaatgataaggaagaccaggaggagctcttcgtagtccagaaaggtagaagtgggagttgtttacttaattttactgtcataccatgctattacctacactcctgtgtgcagtgggcattcagtaaatgtgtgttgaaggactgggacgtacgtggaggctgctggacctggtcagagactgatgtgccttagcggcaatggttagagcttttcagtgcatcccacctccctgtcgcccccatgctcggcttcctcacattcaggagcctgacttggatcagacttggggctgcacagtggagcaggtgggttcccgtgtcattagtaataaggagagggttgggggtgggcagggctccagaaagtcagcagtgtgcctgggcacccaccccatcctctacctgccacacctcagagggttcctacagctgcacacaagcagttgagagttgatgaccaggcccatagggctcccacagctggttcccaggccagtgagtgctgtgagaatacagtagcacaagtccttgttctctgaagagtgggaaggagaggagtgagtgaagtagcctgtcccctgcaggtcctctgcgatggcattgtctcggttcccgcagtgctgcagtgtggaagggagtgccccatcctcattacagatgacacactggagtgtggaggggtcgatgacttgtgcagggtcatatggtacctaaggggcagatctcagacttaaacacaattgatgtctaacccctagacagtctttttagtgccctctgctctcagtcttgttgccctagtatcaagcaatcttagacaaacatcctgaattcttacaaacttacctctaaactctgaggataaagttgccagtccttttaatggtcagcctaatcattctgtcagcctaatcgggtaattgctttttttaataaatacacataaaaacc

SEQ ID NO: 120911 - DNA, 2487 bp, Homo sapiens
  Payload ID: 3693
  Gene Symbol: CCDC175
  Gene Name: coiled-coil domain containing 175
  ENST ID: ENST00000281581
  CDS Start-End: 1-2487
atggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttagtaagcaacagcttagagctttgctggtaacatcaaaagaagaaaaaacgtgtcaactaagtgacttagttatccccaattatgccacaaacattcaattgaacattgatacttatttggggttgaatactcttgtagtgttatccaattctgcctttcacctaagagaattttctagataa

SEQ ID NO: 120912 - DNA, 2616 bp, Homo sapiens
  Payload ID: 3693
  Gene Symbol: CCDC175
  Gene Name: coiled-coil domain containing 175
  Uniprot ID: P0C221
  ENST ID: ENST00000537690
  CDS Start-End: 57-2438
gtggcaaccggcaatccttggctctggcttaggaggcgctcaagtagagcggcaaaatggccctgagcccctggaccccagggctgggcgctggcgagaagctggtgcaggcggctgccgtctccactggcccctccctggagttatgcaccttaccctccaccctgggctcctcggtcgcggtcgaggcgctggagcagctgtttgttgtggaacaatcactgcaaagtgactattttaaatgtaatgaagaagctaagatctttcttaaggacattgctgtagctgttaagaaattggaagaaatgagaaaagccacaatcgatcttttggagattgaaagcatggaactcaacaaactatactatctattggaaactcttcccaatagcattaagagggaattggaagaatgtgtccgagacgctcgcagattaaatctttttgagataaatacaataaaaatgagaattacaaggacagagaatgaaatagagcttctgaagaagaaaataactgacctgacaaaatataatgaagctctgggggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagattaatgaatttgaaaatacccgtgaagtaaagagaatggagacttatcaaaagaagaaagaattggataaattacaaactaaaatgtcaaaaataaaagaaacagttactgtttccgcagcggttcttagtgatcacaatttagagatagcacgactacacgaatcaataaggtattgggaacaagaggtcagtgagctaaagaaagaccttgcaattctggaggcgaaactgtgttttttcacagataacaaagaaaaactagatgatatatctaatgatgaaaaaaatgaattcctgaacaagataaaacagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgaaaatcagaaacagctgacatttatttctcagaaagaatactttctgtcacaaaagagagtagacatcaaaaatatggaagaaggactcatcacactccaggaacttcaacaagcaacaaaaacagtgtatcagcaacaaatcaaaatcctgagtgctaacctggaaagagaaagtcagagatgtgttataactcagtggaaaatggcttgcttgagaaaaaagcatgcacgttggacagccaagataaaagctgaaatacaagctattacagaaaaaattcagaatgcagaagttagacgaattgaattacttaacgagaccagtttcagacaacaggagatcagtggatttgtggcacagattgaaaaacttacaacagaattaaaagaagaggagaaagcatttgttaacaaagaaaaaatgttaatgaaagagttaagcaagtatgaggaaatatttgttaaggaaacacaaattaacaaagaaaaggaagaagaactagttgagtatcttccacaacttcaggtggcagaacaagagtataaagagaaaagaagaaagttagaagagctcagtaatattattacagcacaaagacaggaggaagatttactgaacaatcacatttttctgtttacaagggacttttcaagatacattagcaacatggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttaagaagaagaaacacattcgtacaagggttcatttcccagtggttaaatgtactgagaaaaatacattaacaaagtaactcaaggatacaactgctgtgaattcaaaagacagactactacaggaaaagtgagtgcacttactttcatattttgcagctgttaatagaagtcttaaacatttaaaatttaactaattcacacaacctccaccaagtatcagtaaataaacttctaaacaataaaaatggataaaca

SEQ ID NO: 120913 - DNA, 4131 bp, Homo sapiens
  Payload ID: 3694
  Gene Symbol: CCDC177
  Gene Name: coiled-coil domain containing 177
  Uniprot ID: Q9NQR7
  ENST ID: ENST00000599174
  CDS Start-End: 325-2448
cagcgacggaaccgggcttcttttttaaagaatcaatgtgagggaagggtgcagagccgcgttattttagggagacattgtcgcactccccctcccacgtgtaggtagcatctggggtgcgtgcgccctgttcgcagaccccatggagagacgctggcggcggcagatggggctcctttcacggttgcagccggcagtaacccgaccccgccggcgcagagactgaagaagcgcaggggacagcggcgagctgcgaacaaaagcccttggcgcggggccgaagcccaggacgcgggagattccaacaaaggacggggctcagccatggtggacccagtgcctgaagaagagaaggcaggagcggaacccggcgactctggaggggacgaggccgtggcgtccgtgccccctgattcccagggcgcacaggagcccgcagcttcctcggcctcggcctcggcctccgcggcggtgccccgcaaggcagaagtcccatgtgcagccgcagaaggcgggcggcgggagcagtccccgctgctgcacctcgacctcttcaacttcgactgcccagaggcggagggcagccgctacgtgctgaccagcccccgctcgctagaggcctgcgcccgctgtgcggtcaagccggtggagctgctgccacgggccctggccgacctggtgcgagaggctccgggccgctccatgcgggtggccaccggcctgtatgaggcctacgaggcggagcggcgcgccaagctgcagcaatgccgggccgagcgcgagcgcatcatgcgcgaggagaagcggcgtcttttcacgcctttgagccccgcggccgccgccgccgccgccgccgccgcggcctcggccccgagcgcgggcagcagcagcagctgcagcagcgccagcctcccggcctcgcccgcgccgcgtgcggcccgcaaggcttcccctagtccctcctccgcccggacccaacctccgccagcgggttctcgaacaggcaggaagagccattcgctggactcactgtcccgccggcgtgagggcgccctcagctccgagtcgggcgcatcgtcgtcatcctacagtggggaaagcttgagggagctgcgctggccgcctcgggcctcggccaggaacagctgcccagcggggtcggcgtcctccaccaccaacgctccgggccgcccgtctgccctgaccctggttccgatcaccggccgcagcttcagcctcggcgacctgagccattcgccgcagaccgctcagcacgtggagcgcatcgtgcgtcaagtgcgtgcagagcgcggcctgcgcggggtgccggagcgtgaccggaagatcgcggcgctcatgctggcgcggcaccaggaggagctcctgctgctggagcaacgcgcggctgcccacggccagtgggagctgcagcgcgtgcacgccaagcagcggcgggagcgcgaggagcgggagaagcagcgcgccctagagcagggccgccgagcctgggccgcgcaggtggaggagcggcgaggccgccgtggccgcgaagagcgcgaggcggcgcggcggcggcagcggcagtacgagcgcagcgaggagcggcggcgggagctggccgaacgccagggcctcctgcggcgggagcgggcggagcgcgcggcccgggaggatcggctgcgcaagcttcagcaggagcagaacctgaagcaacgtgaggaaggtctacaggaagggcgggagcgggctgagcagatccgcagggagcgcgcccagcgcgcggcccgcgccaagcagcggcaggagggccagctgcagcgggagaagcgggagctgagccgggccgagcgggcgcgccacgaggcgctgctacagggtcggacccggcagcagcgccaggagcgagagggcctgcggagctcgctggaagccagtttgggccgtgcgcaggagaactacgagcatttggtggagcagcgcacccgggagctgcgggagcgggcccggcgagaggagctgcagggtcggcgggccaaggaggcggcagagcgcaaagagcgggaacatcaggcgcacctggaggcgctggcccgggcgggggagcgacggctgcagcacgcgacgcaggtggccgaggaagcagtgcagcagaaggcgcggcgcgtgggccagagccggctggagaaggaacgagcccagcgcgccaacaaggagaaggtggagagggacgaagactgccgccggcgagagctactccaggccatcgggcgcaagctggagcgcagcgagcagctgacgcgggaacggcgcagtgcgctggagagcgcccgctccacagcccgggcttccttccacgtgcgtgagaaggtgcgcgaggagaccaacacgcgatccttcgaccgcatggtgcgggaggcccagctacacgccagcctggaccgcaaataactgcggctctttgccagccagattggcacgcacagccccctggggcctccctcaaccactgaccatcgtgggagtccccgctcggtgcgcagcgcggtggcctctcgaggcttctgaccaatgaggcaacaacagtacagacgtttgggacctgtcagctggccccctttgtttttaaaacttacttcatttggagatgacagcacaatctgcccacatccacccttgatggctcccgcaccgacccttgccaaacttccctatgtgtctcttgggctggaatagagaagcttgggggaaaggggctgatcaggactggtgagagggccccccaggagagggcagaggtggttgtccccaccccttctgcagcagttgccccaggcacctgttcgacattggtgtctgagacagtgttgctactgctgagggaacatcaccctggctcacctccatctttcaaaatatggcaagctgcacaaatcgcggaggcctcccagagaaacacagctcctccaaggtgtcaagccacgcccaaatgatccaaaaagcagttgattttttagaccttttaatcggccacctgagcaaattctcaccagttttgatagttttccagtttagtcccttgggttttctagttagacagtcatctgcagataatgttcaatttttgtcctttgccccctccctcattctaccaagtggcacaggaaattggttggtttggtgatgctgtttagctttaatagaaacccccagcccctggaggggctggattcctttgggagcagtgttccattccattaagcttccttgcagggtggggcccactccatgaagacagcagtcatgccttaagaagcagagctaccttacgtgcctgcccaggctgttcctgcctaaatctccagccctgcatgccgtctcaagggtgggccccagagagtttggagtgtaggattccctctgtgaaggaatcatctctacttctctgaggacaattagggtatccttggctgctttactgtggtggccgaagagctggaattgcctttgttgagagttgtgttcactatcagtggtcgtgtaccttctccacctgcccccaggaaaaagagtctcccccttaaatttcctggtaccccctcacctatgcctgaaagcatttcaccctctcaatgcctcacctttcccattcgccagatggaaccatcagtattcctctcctggtaccgcaaggcctcctggatccaaagcaccatgtcagtattatttgttggtcctttttgtgcctttcttgacctggagggggaggcaggaggattgctgtcagcctagtttctttctgggaatatggctccctagtgttggaaagggcagtgcctcgtggacagatggtcatttagcctctggggtgaaatacttgcaataccaggtcactctgtggtccaaaaggtcacattcagttgtcatcaggcaactttaacccttagagtgcttcccttccattaagctgaaattgccccacggccatatccacccattgactctgccttcatcaaggaaggtgggaagtaaaacatcactttttacattaaaccaggatcaggaataaaatgttaccaaaaaaaaaaaatggaaacagggtagagaactgctacattaaacatatttcatata

SEQ ID NO: 120914 - DNA, 3087 bp, Homo sapiens
  Payload ID: 3695
  Gene Symbol: CCDC178
  Gene Name: coiled-coil domain containing 178
  Uniprot ID: Q5BJE1
  ENST ID: ENST00000300227
  CDS Start-End: 212-2701
gaccgcagcagagccggaggggtgggcaggcgcgggtccgggagacgcgcggggaaacgcgcggagccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtactt

SEQ ID NO: 120915 - DNA, 3391 bp, Homo sapiens
  Payload ID: 3695
  Gene Symbol: CCDC178
  Gene Name: coiled-coil domain containing 178
  Uniprot ID: Q5BJE1
  ENST ID: ENST00000383096
  CDS Start-End: 184-2787
ggcgcgggtccgggagacgcgcggggaaacgcgcggagccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcatttt

SEQ ID NO: 120916 - DNA, 1017 bp, Homo sapiens
  Payload ID: 3695
  Gene Symbol: CCDC178
  Gene Name: coiled-coil domain containing 178
  ENST ID: ENST00000399177
  CDS Start-End: 144-1017
gtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaa

SEQ ID NO: 120917 - DNA, 3354 bp, Homo sapiens
  Payload ID: 3695
  Gene Symbol: CCDC178
  Gene Name: coiled-coil domain containing 178
  Uniprot ID: Q5BJE1
  ENST ID: ENST00000403303
  CDS Start-End: 143-2746
tgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcattttgtcc

SEQ ID NO: 120918 - DNA, 3039 bp, Homo sapiens
  Payload ID: 3695
  Gene Symbol: CCDC178
  Gene Name: coiled-coil domain containing 178
  ENST ID: ENST00000406524
  CDS Start-End: 25-2700
aggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacaggttgcaggcttcttacctaagaaacttccaaactctctgccaattatatcagatgaactctcaaattttcagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccaga

SEQ ID NO: 120919 - DNA, 1017 bp, Homo sapiens
  Payload ID: 3695
  Gene Symbol: CCDC178
  Gene Name: coiled-coil domain containing 178
  ENST ID: ENST00000579916
  CDS Start-End: 107-670
tggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttcccta

SEQ ID NO: 120920 - DNA, 2925 bp, Homo sapiens
  Payload ID: 3695
  Gene Symbol: CCDC178
  Gene Name: coiled-coil domain containing 178
  Uniprot ID: Q5BJE1
  ENST ID: ENST00000579947
  CDS Start-End: 184-2733
ggcgcgggtccgggagacgcgcggggaaacgcgcggagccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacagctctgtcagctgcagagaaggatgcacacactgtggcaggagcacttcaaactggtggtcctcttcagccagatgaggctggccaacttccagacagactctcaggagagtattcagaaaatattagctgtgcagaaccagtatgatttggaaaaagaataaaattgcttttaaagtacaaaaataattatgaaccacttcaaacgtaatgtctgtgttttatttctcatcagaattcattagtgtgtagcatcaataatttagcccatcatttgccaacactgacttggctcagtagttcaatcatgtaaccctgtaaactcactttccattaaaatgaatgttgctgacaaa

SEQ ID NO: 120921 - DNA, 1700 bp, Homo sapiens
  Payload ID: 3695
  Gene Symbol: CCDC178
  Gene Name: coiled-coil domain containing 178
  ENST ID: ENST00000581524
  CDS Start-End: 1-1095
aaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaactctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcattttg

SEQ ID NO: 120922 - DNA, 604 bp, Homo sapiens
  Payload ID: 3695
  Gene Symbol: CCDC178
  Gene Name: coiled-coil domain containing 178
  ENST ID: ENST00000577766
  CDS Start-End: 294-604
gcatggagtcctggttgtatcatcccaagtggcaagaaagaaagaggtcctgcggtcctcccgaaggtggacgaagtctgtgatcccctcacgttctaacctcactgctgtacgaaggggcgttgactcgtctccactccttccctctccgtgtctgctcaatcaagtcaaatactgaacaacttcctggcggagaggctgagaattttatacttgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatcca

SEQ ID NO: 120923 - DNA, 3094 bp, Homo sapiens
  Payload ID: 3695
  Gene Symbol: CCDC178
  Gene Name: coiled-coil domain containing 178
  ENST ID: ENST00000583930
  CDS Start-End: 80-2755
tgcttgctcgaaagcaccccaaataagatgatccacgccaacacctcccctttacaggttttaaaatattcttataactatgactgaaaacaagacagtttcctcttcttccactagagatgatcaaaccaatataggtttaacatgtcaggaagtaaaggctctcagagagaaggcatggtcaaggacaaatgaaggcaatgccatgtctcaaagtttggttctatatggagcctctaaggagaacagtgaaggttttcatgaaagtaaaatgacaaatactgaaggggtgaataaaggcatttactttagctacccatgtcgacgtcacagctgtgccgtagtaaatattccagcaccttgtgtcaacaaaatgatttcacacatccaagatgtggagtccaaaatacaggagcatttgaaaaggtttgaaacttcttttgaagaatggagcagaacttcttccacaaaagacctgaaagaagattggagtgtaactacaccagtgaaagaggtcaaaccaggagaaaagagagatgaaaagtgtccagagttaaagcaggaaatggaaacattgctctcagaggccattcgtctcattaaaagtctagaaactgaccgggcagacgctgaagaagctttaaaacaacagagatcaagaaagaatatgattaacatgaaaattgactcttggtcagtctggaaacttcaagaactcccattggctgtgcagaaagaacatgaggcctatttgagtgatgttatagaattacaatggcatcttgaagataaagctaatcaactacaacattttgaaaaacaaaagacagagttagaagaagcaaatgcaaagattcaagcagacatagactacatgaatgaacatggccctctactggactctaagcagaatcaggaacttcaagatctgaagaaccattataaaaaaaaaatggaggtaatggacctacacagaaaagttaatgaagaacttgaagaagctttagaagcctgtgaaaatgccagattgaaggctcagcaaattaaagaagagattgataaggatatttaccaggatgaaaaaaccatagaggcctacaagagagagatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagtaaaaaccaatgaaagcatacggaaaaaatcaaaatacgaatctgaaataaaatatttgacaataatgaagttaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcgacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacaggttgcaggcttcttacctaagaaacttccaaactctctgccaattatatcagatgaactctcaaattttcagctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccaga

SEQ ID NO: 120924 - DNA, 876 bp, Homo sapiens
  Payload ID: 3695
  Gene Symbol: CCDC178
  Gene Name: coiled-coil domain containing 178
  ENST ID: ENST00000581852
  CDS Start-End: 49-267
aacttgctctgcaaaataacaacccaggatcagattttccccttcctcatgctctgtcagctgcagagaaggatgcacacactgtggcaggagcacttcaaactggtggtcctcttcagccagatgaggctggccaacttccagacagactctcaggagagtattcagaaaatattagctgtgcaggaggaatcttcaaatttaatgcaacacatcttaggtttcttccagactttgacagatggcacatgcgaaaacgatggttaagcaaacaaccaatgtatcttggatgctgaaataaaagacaagaaaagtcacacagttcagataacagtgtaattggacattcacctgtttgccatttcacacttccatgaacgaaaaactcactcacctcccagcatgctttgccactcttttactcacagcaaatccataacaatgaaacaggtgactttcatgctgctgtcaggaacgatctaatttcagctctgggtgactgattgcaattggctttgcctcatctgataattaatctatgtcaccattaattggaagagagaataattactggcggtgttgacagtgactgttcgcttccccagatttccctatcgtcttggcccaaataaaggctttgccattcagtacttaaagtttgtgtaaactgtaacaatatctatgcccatgtgacactttgagacactctgtctaatgtacttttgtttttgtgtttaccagtcttttttagctcactgagagctgtctctctcaatcactcctcaatgttctatcttaattttgtggaagtttaaagttttcaatgagctggagatgaatgattaatgaataaatttaaatgcttcattttgtcca

SEQ ID NO: 120925 - DNA, 791 bp, Homo sapiens
  Payload ID: 3696
  Gene Symbol: CCDC179
  Gene Name: coiled-coil domain containing 179
  Uniprot ID: H3BU77
  ENST ID: ENST00000532798
  CDS Start-End: 6-212
acggcatgtgcctgtattgctgggacatcgagccttcccaagtcaaccctgaaggaccaagacaacatcatccttcagaggtcactgagcggcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtggattgtgaacatcaagtgacatatcatgaattgatcatccacaaaataaatgcaatactccaccatttcggaaaaataaacacagtgcaagtatttaatatccaagctacaggctctagaattttattaaatgccatctctcactaccatatttttctttcctgtggtaaacttgaaatttgctgcttttcaacaaataataatgaatatgtataggtagacttttgaaaaatattattctcatttaaatttttgcaaatgttttatgacatatttagatgtttagaagtatgttataataatagaacaccagatttcctctgctgtatatttataatgacttccatttaaacaaaatgtttaaatactttaaacagtcctaggagactgttattataactaactcctgtattttgtgttgctattgcagataagccatagtgtaattaaaatttccatttaaggtaaaatttgaatattgaattaaaattttacttttaggtatgaaataaattataattattgctga

SEQ ID NO: 120926 - DNA, 4867 bp, Homo sapiens
  Payload ID: 3697
  Gene Symbol: CCDC18
  Gene Name: coiled-coil domain containing 18
  Uniprot ID: Q5T9S5
  ENST ID: ENST00000343253
  CDS Start-End: 503-4867
agcgggctggcttcctgaacggccctcgcctcttcaccaccagggccgtccaccagaagtttctaaacgggtgagaggcgacaacgcagtgcagctgggttaaaggaaggaggctggtttatcctccgcacttacttggtactcgatctccagcgaggccttcaggggcatgggctggtagaagcactccttctggccggcgggaagggtaaaggtgaagtcgctatcgagggaaggtgtgaagccggccgccccaggcagcagcaccggaggcagagcggccagaaggagcacggggaagggcagccagatcttgtcgcccatccctgctggggcgatcccgggctgaaagaggcgtcaggtactgttgtctccgctccgcgtttcctctctggactcctcgtggttgacagggaaatctggagtctgaagaaactccaggtggcggccgcggcggcggcgaacactccctccgaaagagaagcgcagttctccaaaggaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcagggagaaaatgtgtaa

SEQ ID NO: 120927 - DNA, 4779 bp, Homo sapiens
  Payload ID: 3697
  Gene Symbol: CCDC18
  Gene Name: coiled-coil domain containing 18
  ENST ID: ENST00000370276
  CDS Start-End: 1-4526
ggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcagggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaaatcattgttaaaatgca

SEQ ID NO: 120928 - DNA, 4552 bp, Homo sapiens
  Payload ID: 3697
  Gene Symbol: CCDC18
  Gene Name: coiled-coil domain containing 18
  ENST ID: ENST00000401026
  CDS Start-End: 523-4422
gcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagacttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaaggagaaaatgtgtaattcaaagaagatactgatgtgttgaaaaaatggaatttttggtactgtgctgtttacttattatatgtagctcatacttcatagaagctgttattttgcttttgaataaattttatatttcaatatttta

SEQ ID NO: 120929 - DNA, 2161 bp, Homo sapiens
  Payload ID: 3697
  Gene Symbol: CCDC18
  Gene Name: coiled-coil domain containing 18
  ENST ID: ENST00000455267
  CDS Start-End: 1-2161
gaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccattaaaaagagaattatttggctttaaatcatatctttctaaataccagatgagtagcttctcaaacaaggaagaccgttgcattggctgctgtgaggcaaataaattggtgatttcggaattgagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatgcttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaa

SEQ ID NO: 120930 - DNA, 496 bp, Homo sapiens
  Payload ID: 3697
  Gene Symbol: CCDC18
  Gene Name: coiled-coil domain containing 18
  ENST ID: ENST00000448243
  CDS Start-End: 1-496
cccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccggaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaa

SEQ ID NO: 120931 - DNA, 1751 bp, Homo sapiens
  Payload ID: 3697
  Gene Symbol: CCDC18
  Gene Name: coiled-coil domain containing 18
  ENST ID: ENST00000481180
  CDS Start-End: 1-1331
gtccgaggcttccacgcgcaggggcccgggaaagggtcagaggcttcctaacgcagactcgagtgcgaagcgcgcagtcgccgggtgggtctctccccagcgacgatttgggtgaaatggaatctagttcatcagactactataataaagacaatgaagaggaaagtttgcttgcaaatgttgcttccttaagacatgaactgaagataacagaatggagtttgcagagtttaggggaagagttatccagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattgaaaaggaacagagtttgcaggagtccaaagaggaatgtataaaattaaaggtggacttacttgaacaaaccaaacaaggaaaaagagctgaacgacaaaggaatgaagcactatataatgccgaagagctgagtaaagctttccaacaatataaaaaaaaagtggctgaaaaactggaaaaggttcaagctgaagaagaaatattagagagaaatctaactaactgtgaaaaagaaaataaaaggctacaagaaaggtgtggtctatataaaagtgaacttgaaattctgaaagagaaattaaggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccaaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagct

SEQ ID NO: 120932 - DNA, 541 bp, Homo sapiens
  Payload ID: 3697
  Gene Symbol: CCDC18
  Gene Name: coiled-coil domain containing 18
  ENST ID: ENST00000479653
  CDS Start-End: 1-288
tccgagttgtgtccgaggcttccacgcgcaggggcccgggaaagggtcagaggcttcctaacgcagactcgagtgcgaagcgcgcagtcgccggaaatggaatctagttcatcagactactataataaagacaatgaagaggaaagtttgcttgcaaatgttgcttccttaagacatgaactgaagataacagaatggagtttgcagagtttaggggaagagttatccagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtttctatgcttgagtctgctcaacagcaggcagccagtgtcccaatcttagaagaacagattataaatttggaagcagaggtttcagctcaagataaagttttgagagaggcagaaaataagctggaacagagccagaaaatggtaattga

SEQ ID NO: 120933 - DNA, 5242 bp, Homo sapiens
  Payload ID: 3698
  Gene Symbol: CCDC180
  Gene Name: coiled-coil domain containing 180
  Uniprot ID: Q9P1Z9
  ENST ID: ENST00000529487
  CDS Start-End: 98-5203
gagcgccgttaacttttccccgaagagcatggcagagtgaagcacaagcaataatcctgtattattcgcgttcccagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgcggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcacacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaacttcgagctggcttcttcgagcaccttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcagccgagcttttgcttcatcaagagcagttggacagccactgtgctggggtgaccgagacgctgaagaagaagcggctgatgttctgccagttccaagaagagcaaaacgtgaggagcaaaaacttccgccttaagatctatgacatggagcacatcttcttgaatgccaccaggagccaaaagctggtcactctcagcaacacactgcaccaggagttgcttagctatgttgatgtcacccaggtgtccctgcgcagcttccggcagtacttggaggagagtctgggcaaactccgctactcaaatattgagttcatcaaacactgcagattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggtagaggcgcatgggcctgtgggtctcggggcagcagtgaggcaggggctggtggtgctgtgtgctcacctcctgtcctctgctcctgtcctgggccctcgtcacccaaaggcttcaagcgacatcggtgccagccagaaaactctgggaagaaggctgtacccagtgccagtgctacctctgcaggcagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacaga

SEQ ID NO: 120934 - DNA, 1914 bp, Homo sapiens
  Payload ID: 3699
  Gene Symbol: CCDC181
  Gene Name: coiled-coil domain containing 181
  Uniprot ID: Q5TID7
  ENST ID: ENST00000367805
  CDS Start-End: 211-1737
gctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgtaa

SEQ ID NO: 120935 - DNA, 1860 bp, Homo sapiens
  Payload ID: 3699
  Gene Symbol: CCDC181
  Gene Name: coiled-coil domain containing 181
  Uniprot ID: Q5TID7
  ENST ID: ENST00000367806
  CDS Start-End: 154-1683
agtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagacaggaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgtaa

SEQ ID NO: 120936 - DNA, 1246 bp, Homo sapiens
  Payload ID: 3699
  Gene Symbol: CCDC181
  Gene Name: coiled-coil domain containing 181
  ENST ID: ENST00000456107
  CDS Start-End: 179-1246
agagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagag

SEQ ID NO: 120937 - DNA, 2035 bp, Homo sapiens
  Payload ID: 3699
  Gene Symbol: CCDC181
  Gene Name: coiled-coil domain containing 181
  Uniprot ID: Q5TID7
  ENST ID: ENST00000545005
  CDS Start-End: 509-2035
ggggtccaatttgtgcgcgtggagtgagacagaaaacctggagcccgatctcccggccagcgactccctccttctgggtgtgcggctgaagactggaagcaggttgccttgcctgctgcaagcccgccgtacctaccccttctccgcgtgcgcccctccctgtgcctgcgcattaccggctagccggcggcgggcgctgcagcccctacgtgattctgcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggatgccaaaaaccatggaagacttctgatgttctgggagggttgacaaagatggaccttaaattctagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactga

SEQ ID NO: 120938 - DNA, 1652 bp, Homo sapiens
  Payload ID: 3699
  Gene Symbol: CCDC181
  Gene Name: coiled-coil domain containing 181
  Uniprot ID: Q5TID7
  ENST ID: ENST00000491570
  CDS Start-End: 211-1467
gctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagtaagtaaaacttctctgaaaaataagttcatacagatatgaaagctgaacttatttatagaagggagtctggatatcagactaacagcctatggaagaagtagaaaagttgttcaagaactacccttgcaaaagatgcaacatgcagataactacaattaggttctaagaggtcttgtgaaaataaaatgattcctattttgttcagactttgatggaacagaaaa

SEQ ID NO: 120939 - DNA, 832 bp, Homo sapiens
  Payload ID: 3700
  Gene Symbol: CCDC182
  Gene Name: coiled-coil domain containing 182
  Uniprot ID: A6NF36
  ENST ID: ENST00000299415
  CDS Start-End: 41-502
gtctcttggcttcctctctttgtccaacgtagaagagacaatggaacccctctaccaggctgggtccattctcatgacggtgaataccctacaggggaaaaaaatgatagagagtggcctccagtctggagacttttccctgtcccagtcatggccctcctgcctcccaccacccgctgacttggagatcctgcagcagaaggtggccggggtgcaacgggaactggaggactttaagaaagaggcattgaagtccattcattaccttgaagacgccttctgcgagatgaatggagccctggtgcaacaggaggagcaggcggctcgcgtgaggcagcggctaagggaggaggaggaccgtggcatcgtgcgcaacaaggttctcaccttcctgttgccgcgcgagaaacagctccgggagcactgcaagcggctggaggacctgctgctggacaggggacgtgacgccctgcgtgccaccaagaagagccaggctgactgaacctcgtgggtggcactagccaagcaccaagttgaagattttttttaacggaaggagaaaccccaagtccctacccccttgctttcccttcctcatttccattgctttccttctgcctaaataacaccttgctgagaggcaaaaagacttcaatattttttttggtgaaattccatttatccagcattctaaaggaaggaggcaccccagtactgagtcaggcccctgtaactttcacttgaactgttttcctgtttgtaatggtactattgctcaatgtatacctctttatttgtatagtatattcttaaactgattgtgttgaacatt

SEQ ID NO: 120940 - DNA, 1671 bp, Homo sapiens
  Payload ID: 3701
  Gene Symbol: CCDC183
  Gene Name: coiled-coil domain containing 183
  Uniprot ID: Q5T5S1
  ENST ID: ENST00000338005
  CDS Start-End: 36-1640
gtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaagtatgaccagtggaccatctccaaggcctgcgggaaaaacttgcctttgcgactggcgcactgccgcagcaccatggaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacac

SEQ ID NO: 120941 - DNA, 1786 bp, Homo sapiens
  Payload ID: 3701
  Gene Symbol: CCDC183
  Gene Name: coiled-coil domain containing 183
  ENST ID: ENST00000479371
  CDS Start-End: 49-1005
gggaggctttgaggtacacagggtcccttggggggcctgagagcagccatgaggaggcacagtgagacagatgtggaagagcagacccaggagctgaagaccatcactcagctccaggagcagtgtcgggcactccagatccaaggggtgaaagagaatatggaccagaacaaggccacgctggccctcctgcgcagcaacatccgccgcggggcccaggactgggctttggccaagaagtatgaccagtggaccatctccaaggcctgcgggaaaaacttgcctttgcgactggcgcactgccgcagcaccatggaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccagga

SEQ ID NO: 120942 - DNA, 2343 bp, Homo sapiens
  Payload ID: 3702
  Gene Symbol: CCDC184
  Gene Name: coiled-coil domain containing 184
  Uniprot ID: Q52MB2
  ENST ID: ENST00000316554
  CDS Start-End: 540-1124
tttacgtgccgtgcgtcgccttggaaacagaggagcatccgcgacacccccgggagacccaccccagctgctgctgccacactcgcgggcgctgcccggtaatggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctccgcttccctcggctcccgctagcccctcccgggacctctccccctccaccccctcccccaccccggaggccgggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcacttggacagctgctcttgtgggtcaggcagagagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgactttgtgtgccctccccctcctttgtgtattccttctcaatgctttccttggtgttaaccttaataaaaaggcgtcatctcccctc

SEQ ID NO: 120943 - DNA, 2054 bp, Homo sapiens
  Payload ID: 3703
  Gene Symbol: CCDC185
  Gene Name: coiled-coil domain containing 185
  Uniprot ID: Q8N715
  ENST ID: ENST00000366875
  CDS Start-End: 60-1931
agcgtcctcgggaggtctcaggccccttgggcagacgctgcgcgtgcccagagggagggatggcaggcttcagccacttctcccagccgccctaccgggatctctgggaacccccgcggcccggcggagaacgagagtccacgcagcggctgggcgggcagaggtccggagccgactccaccgcgtgctcccgggccgggactccgggtgcggagagcgaagctggggcgtgctggctgcacccgcactgttcgttcaccccgcggcctcgcaggcgcgggtgctcagattcactgcggggcagccgaagcctgagcgatgtggcccgcaggcccctggaacgttccaggaagcaccggccccgcagcaggcgcctggaagatgcctggggagagacaggaaccaagccccgcccggcttggcagccgcagacccagctgccaccccagcggccgcagccctgcccgcattaccctctggcccagggagactcgcccccgccttgccccggaggagctggcactcccctgagtggcacattcagggtagaaaaggcacagggtggagaccagtgggcagtgccactcggcagacatctaggtcgctggtccccttcctcagttccctcggagcggtcttctgtgccctcgcaaaagttcaagaggcactcagcctgcgtgtgcgcccagaagagagacagcagcgaccaggttgagtcattagccagccgggactcccagcccttggcctccagcaaagagatgcggagcccgcacacccaggtcctgaagagcaagctggaagaggtggtggtgtcctcccaggaccagcagattgtggccctggtgctgacccgtctcaagaaggcccagaggatacgggagctgcagcagcaggcggctaaggcctgggaggagctgaagcgctcggatcagaaggtccagatgaccctggagcgggagcgccggctgctgctgcggcagagccaggagcagtggcaggagaaggagcagcgcaagaccctccagagccctgagcagcgcggcctgcggcgggacagccagaggaagaacgtgcccccgggggaaagccggtggaaggagcaaccagaggaccaggagagcccgcgccaggagaagctggagaaggcgcgcgcccaggcagagcaccgaaaacagtgccaggtgcggcgcctgcgggagcaggagaagatgctacggaacctccgggagcagcacagcctgcagctgcagaggaggctggtggaagcctgtcgcaagaggcacctacatgccgtggagggccagaagaaggtccaggacaccaacctgagctccctcatcaattaccaggcccggaaggtcctcatggactgccaggccaaggctgaggagctccttaggcagctgtccctggaacaaagtttccagcggtcccaggagatacaccagggcctgaggaaggagcggcaacgcgagctgagggagaaggcccagaaggaggaagagcagttgcagcaggccaggtggcgcgcaggggagtcagaggaacagaggaagatgcgcaaaagaattctggtggagctggcggatgagaagatccgacaggccaggagtcacgtgcacaagaccactagggacaaggtgcagcacctccgggagctcaaccacctgagggagaaaaaccaccacatcctgaaactgaaagccgagaaggaggaaaagtgtcacattgagggcatcaaggaggccattaagaaaaaggagcagagggtgcagcacatttcccaagggaaagacccaaacttccaggagttccagaagctccctcaggcctccaggagagaggagagagcgcctcccaacagctcccttgatcagatggtactagaggcccagctccgtgcctgtcagcagaacaggggttactgagaaccaaggacgcctggcttacagtgcgcagccagaaggagatgtggcaatgtgattccttttgtaatctgattataattgaacattgattttaaaaaagcatgtaaaatagctgcaatttcc

SEQ ID NO: 120944 - DNA, 2035 bp, Homo sapiens
  Payload ID: 3704
  Gene Symbol: CCDC186
  Gene Name: coiled-coil domain containing 186
  ENST ID: ENST00000369285
  CDS Start-End: 375-1010
tctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggaggaaaaagtcctggatttcgagtcagaacatctggattagaatcctacttctttcacttgataatcttgttacctgtggaaatcagaagagagaatatagtaaaaatacgcagtacagtcccagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaa

SEQ ID NO: 120945 - DNA, 1928 bp, Homo sapiens
  Payload ID: 3704
  Gene Symbol: CCDC186
  Gene Name: coiled-coil domain containing 186
  ENST ID: ENST00000369286
  CDS Start-End: 268-903
gcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaa

SEQ ID NO: 120946 - DNA, 7245 bp, Homo sapiens
  Payload ID: 3704
  Gene Symbol: CCDC186
  Gene Name: coiled-coil domain containing 186
  Uniprot ID: Q7Z3E2
  ENST ID: ENST00000369287
  CDS Start-End: 268-2964
gcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaaaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtgcaatatgacagcctgtcattgaatctaaacaacttaatttgcttgtattcataagaagtgttgaacattacaagggcttttataaaaaaccctttgttcatatttcttccctttaaaatatgtaatgtcaaaaatgactcaccttttaaaaattatgcatgaaaacaggtggtaaacattcagtaatacgctatttctccaacatcaagacaactaaaacaaatgataaaaatgtttatttttacactccagcatatcgggtgagttttagggatgtgtatgaatatttaaatcttttaatttcagttttaatgaaagctgaacttaataggaaagctagctcttggtaactagcaatgatcaggcattgtttgcctctgtcaggttttcttatctgttttaggtacattttttcagattctgattgtttgagttaatggttgaatttttaaagtttttagttacttaaaatatgattttaaattacatattaatttagaaaattcctgtgtttacttatattttaaattgtgaaatggatccaatcattagaacagagagaatagttctttgaaactgaaatactttagttttactgaccttgtgtaaagataatatgaagaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcaccccttattatttctcacttacaatttctgagcatgatttttcataattcattatcttcagatcattactataataagataccgtggctcttatgcagatattgcagcaagccttgtttggtttggatttttgcatccctttttctcccattaagggaattaagttttgggatgatggattaaaagcctgtaaagaattgtttgggctctaaaagttgggctcatggtggcaatatccttttaatgtgttttaacattttttaatcaacatcgtttaaaaataatttactaaggattagattatttaatgaatgtctttttttctatatattgaattagatgttatcccaaaaaaaatatcttttcacttcaaaatgaaaatatatgttcaaagatgttttatttttagaatagttataaaaagtattagtcttaacataatgtgtcttgttctttttaccaataataatttatcaaaataagagggaaagtgcaatcaaatctgaattattttactatttgtttctagacacactacttaacactcctaaagactactttgagtaggcaacataactaaatttttctagtttcttatgatacaggttcataaactacaatatttggatttttttccccaaggcacaaaatgtataatggagaccaaatagtgatctgatccatagtatcctatgcctatacactttaaaatgtatatacattttagacaaaaatgcacactccagtattaatatttgtgctaccatctacttggagaagtttaatgagaaaattttagaagaaaagtattacaaacaatattttgactctattacctgttttgccttatacattttagaaactggaaattttttaaagaaaatgctttagttttcttctgttcttcactgtctacagtgtgcttttgtatatggatcaggactgagcaaagtaattacatgtatcagagatacttatctctatactaattcacagacagctcctgatgtaaggatttagagggccttctgccctctgaatatatggtgaggagaatggggtatctggaaaaggaaaatgatctggataaatctgagacctggggggaagtttgttttatatgttcattattggttgttacatatcaaggctgttttggttatgtatcaatattgtggtttatttgagctggaagtgattttttctgtgtatgtatatgtatacacttcaataggttttaattttgaagtgaatatttgccatgactccattttccccataccacttcagactttagcctgtttagttttaaggactgaaaatggtaggtttgggcagaagaatgaatttgaactttgatggggtttttttgtttttactttctatcttcataaccatttaaagcgatttagcttgaaattaaattttatcaggctaccaacatgttatttatttatttaataaacacatttattgaaaacctatactattgtattggcaccatacagggtattgtatttatactagtgagcagaccagggcatttccatcctcatggagttcatggtctaatgaaaatagctggggccgggtgtggtggctcacccctgtaatcccagcactttgggaggctgaggtgggaggattgtttgagcccaggagtttgagaccagccagggcaacatggcaaaaccccatgtgtacaaaagattaaaaaattagccagatgcagtggcacatggctggggtcccagctacccaggaggctgagttgggaggatcatctgagcctgggaggttgaagcttgcagtgagctatgattgccactgtactctatactccagcctgggtgacagagtgaaaccctgtctcaaaaaaaaaagaggaaagaaaatagctaggagacaatcagagcagatcttgggcttctgtggctcatctcagccctttataactggcctgagaagagggtttatctacttgtgcaagtggcccagaaatctcactcgtacatgaggctttggaacatccttgcaaaggtacgctgaaagcaaattgctgttttcctggtggttctgcacgtttcctaacttttatcatagtttgattttcattatttaagaaaaaataaaaaatccaaagaccataagatggcattagattttttaccattaaattattaatgcctatttggtgctcataaagattaatcatgtcacgcatgtttccaatctttcttttgcagtatattattttctaaaaattgttacatgcaaatttaaaccaagatttatcagtaaaagaaaaaaatagaatccttaataatgtaaatgttgttatatatgctaccctggtgaaaatatttttataaatcatgttgtcatttatgctttatgtagcctatttttcaataacctttttttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgtacagatacctttaatttgattacactgtttcttgtaaatatgtttctgtataaaatgaaacttttcaagaggattctatgtatatattgtacttattaaataggtaatgcctatttaccaa

SEQ ID NO: 120947 - DNA, 1576 bp, Homo sapiens
  Payload ID: 3704
  Gene Symbol: CCDC186
  Gene Name: coiled-coil domain containing 186
  ENST ID: ENST00000428953
  CDS Start-End: 1-1309
tagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcaaaaagcacatgcccggaaaaatgaaaagatagaatttatggaggaccacatcaaacaactggtggaagaaattaggaaaaaaacaaagaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtg

SEQ ID NO: 120948 - DNA, 3158 bp, Homo sapiens
  Payload ID: 3705
  Gene Symbol: CCDC187
  Gene Name: coiled-coil domain containing 187
  ENST ID: ENST00000569961
  CDS Start-End: 242-3139
ggcccgccatcaccggcctcagagacagccgcatgtctgggccagtcacggctcttggcctctgggccccaccgttgctgggaaggggaggctctgcgcacctgcagctgaggatgacgtggcagccctgaggtggcccgggccctcccagcagccagacccaccctgggcagctccccacgtggtcgggtctgacgacctcaaggaaccaggaccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgttggggccccagcagaggcccagaaagagtgacgcgcggctggagcagctgagagacaagatccgggcccaggcgtggcagcaggggagctgtgcgtccctgggcacctcagccccctccagcgcctccagactccacaaagcctccacgctgatgcttaggaggaaaggccaagaggcaaaaaatccccctccagcccctgaatgctcaggtttcagcatcttgagtgcagctgagcgcagagttgaagccaaggcatcccacggccaggggcgcgagctctccagggtctcccagcaccaggttcctgttctgagggaaaaacccaaaagggtcaaaagcagttcttgcaaaagagagaagacccccaagttgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaagtgctcaccggtttgtgcccagttgcccgatgccacctccgcctacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcagggaggggctgctgcagggaccccaatgcccagagctccttctctaagagtccctgggccatgacagagaggaagcattcctctttagagagggctaggagtgtccacacctgggagccctggagctcctccactgcacgggagtcctgtccgcagagggcctggggggcccaaggacaggaccgctccttccagaggccggagagtccccatgagaggttgggccacttctcccagaggccctggagtgcactggctgggcaggcctgcagtccgcagagggcctggggggcccaaagacagggcccctcctcccagaggcctgggagcccccctgaaaagcggagccccttcccccagcagccctggagtgctgtagccacacagccctgtccacggagggcctggactgcctgtgaaacctgggaggaccctggccccagactgcggaaccctctggaaaggcccagtcctccagcccagcggccctggagcagctccggcgtgcagagggccggcccccagggcaagggcagaggcatcggctcccccgtctcggctgccaagcatgccctgccaaggcccaccgggagcttccctcagaacccacttgggaaggagaaggacacgctgcggccctgccccaggtcccgggggctcctgggaccctcgcacagctctgagtccttgcgggagttcatgcgccagaaggcgcaggcccggcggcggcaggccctggaggagaaggcctcggccctgcgcacacgggagctgaggagccggaggctgcaggaggtctaccggcagcagagggaggccgtcctcggcagggcggtccccgtggtctcccggaccacccctggcatcgtgacctttgtccccagttctgcacagtccgggggcctggaagcctccgggagcctggagtccccagtgctggaatggagcaaagtgacctctggcatggtgctggggggccaggaagccccaggcagcttctgcctgtgtttgaacagagcctggaaccatgctgagaccctagatcccccagggatggggggcccccaagatggccgggatgcccccgtgctgctgtcagcttcaccctctctgggatccctggagctccaggacctgaccacccgctacctaccccgggggatgtgcatctacctggacccaaaggaggctgagcacctgggcacttccagctccctgcacctccggcataagcaggcgcagctgcaggcgctagagaccacagccaaagtcctcaagcagcgggtcgatagcctcaccgccaagctgcagggtgccgaagcgctggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggacggcgagacactgtcgtggggccccagctgggagcaacagcagagtgtgagcccgagggcccactgcgagagcaagccccgaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggctttcgg

SEQ ID NO: 120949 - DNA, 3543 bp, Homo sapiens
  Payload ID: 3705
  Gene Symbol: CCDC187
  Gene Name: coiled-coil domain containing 187
  ENST ID: ENST00000563590
  CDS Start-End: 241-3102
cagcccagggccgggctgcccaccgtgccagcccagtttcaatgacccacctgagggtttccatcgtgggccaggggaccggcgcaggcgggcatccggagccaggcagtggccagcccatcccgggcagggtcataggtggggctgcaggcctcgaagccgccatgtgaaggcagcagcgaccccaggcagggcgggccaggttgaccttgcacctgctctcccctcagccccgcggccatgccgaccctggtcgtgggcacgccgcccacctgcctgggggacacacctcagccctgccacaagaacagccagaggcagggccccttctcccatggggccccagggagagcagccgactggaaggctgttgccaagcccaggctctgcgcacctgcagctgaggatgacgtggcagccctgaggtggcccgggccctcccagcagccagacccaccctgggcagctccccacgtggtcgggtctgacgacctcaaggaaccaggaccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgttggggccccagcagaggcccagaaagagtgacgcgcggctggagcagctgagagacaagatccgggcccaggcgtggcagcaggggagctgtgcgtccctgggcacctcagccccctccagcgcctccagactccacaaagcctccacgctgatgcttaggaggaaaggccaagaggcaaaaaatccccctccagcccctgaatgctcaggtttcagcatcttgagtgcagctgagcgcagagttgaagccaaggcatcccacggccaggggcgcgagctctccagggtctcccagcaccaggttcctgttctgagggaaaaacccaaaagggtcaaaagcagttcttgcaaaagagagaagacccccaagttgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaagtgctcaccggtttgtgcccagttgcccgatgccacctccgcctacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcagggaggggctgctgcagggaccccaatgcccagagctccttctctaagagtccctgggccatgacagagaggaagcattcctctttagagagggctaggagtgtccacacctgggagccctggagctcctccactgcacgggagtcctgtccgcagagggcctggggggcccaaggacaggaccgctccttccagaggccggagagtccccatgagaggttgggccacttctcccagaggccctggagtgcactggctgggcaggcctgcagtccgcagagggcctggggggcccaaagacagggcccctcctcccagaggcctgggagcccccctgaaaagcggagccccttcccccagcagccctggagtgctgtagccacacagccctgtccacggagggcctggactgcctgtgaaacctgggaggaccctggccccagactgcggaaccctctggaaaggcccagtcctccagcccagcggccctggagcagctccggcgtgcagagggccggcccccagggcaagggcagaggcatcggctcccccgtctcggctgccaagcatgccctgccaaggcccaccgggagcttccctcagaacccacttgggaaggagaaggacacgctgcggccctgccccaggtcccgggggctcctgggaccctcgcacagctctgagtccttgcgggagttcatgcgccagaaggcgcaggcccggcggcggcaggccctggaggagaaggcctcggccctgcgcacacgggagctgaggagccggaggctgcaggaggtctaccggcagcagagggaggccgtcctcggcagggcggtccccgtggtctcccggaccacccctggcatcgtgacctttgtccccagttctgcacagtccgggggcctggaagcctccgggagcctggagtccccagtgctggaatggagcaaagtgacctctggcatggtgctggggggccaggaagccccaggcagcttctgcctgtgtttgaacagagcctggaaccatgctgagaccctagatcccccagggatggggggcccccaagatggccgggatgcccccgtgctgctgtcagcttcaccctctctgggatccctggagctccaggacctgaccacccgctacctaccccgggggatgtgcatctacctggacccaaaggaggctgagcacctgggcacttccagctccctgcacctccggcataagcaggcgcagctgcaggcgctagagaccacagccaaagtcctcaagcagcgggtcgatagcctcaccgccaagctgcagggtgccgaagcgctggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggacggcgagacactgtcgtggggccccagctgggagcaacagcagagtgtgagcccgagggcccactgcgagagcaagccccgaggtgtgtctcaggctcctctcctgctgtgatggcttgggtcccccgtcccgtgctcccggctgaccagggagtgaagccaggtgccctcttctccaaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggct

SEQ ID NO: 120950 - DNA, 3918 bp, Homo sapiens
  Payload ID: 3705
  Gene Symbol: CCDC187
  Gene Name: coiled-coil domain containing 187
  ENST ID: ENST00000624277
  CDS Start-End: 270-3461
agctcattaggaaggcccccagctgtggccagcccagggccgggctgcccaccgtgccagcccagtttcaatgacccacctgagggtttccatcgtgggccaggggaccggcgcaggcgggcatccggagccaggcagtggccagcccatcccgggcagggtcataggtggggctgcaggcctcgaagccgccatgtgaaggcagcagcgaccccaggcagggcgggccaggttgaccttgcacctgctctcccctcagccccgcggccatgccgaccctggtcgtgggcacgccgcccacctgcctgggggacacacctcagccctgccacaagaacagccagaggcagggccccttctcccatggggccccagggagagcagccgactggaaggctgttgccaagcccaggctctgcgcacctgcagctgaggatgacgtggcagccctgaggtggcccgggccctcccagcagccagacccaccctgggcagctccccacgtggtcgggtctgacgacctcaaggaaccaggaccctgggggaaggcgtgcagcctgcccatgtggtccacaggcccggaggctagggatggggacagctcggtgtcatcgggccgcctctcgtgctcttcggggggccacgacgtgtgtgtgtcttggaaggagaggccaccccaggtgttggggccccagcagaggcccagaaagagtgacgcgcggctggagcagctgagagacaagatccgggcccaggcgtggcagcaggggagctgtgcgtccctgggcacctcagccccctccagcgcctccagactccacaaagcctccacgctgatgcttaggaggaaaggccaagaggcaaaaaatccccctccagcccctgaatgctcaggtttcagcatcttgagtgcagctgagcgcagagttgaagccaaggcatcccacggccaggggcgcgagctctccagggtctcccagcaccaggttcctgttctgagggaaaaacccaaaagggtcaaaagcagttcttgcaaaagagagaagacccccaagttgccctcccctagaagagcggccaaagacaaacacaaagacgaagattcggagctggttggtgtttacgcctggagaaagggacaagctctggtgaggtcgctgcttgggccccctcccgtcctccgcaggcaccatagcaaggatccctcgagagacccggctctcaccgtggacttaggagacagcgagaaagtcatagctgccaagtgctcaccggtttgtgcccagttgcccgatgccacctccgcctacagtgaccagcaggtgtctgggaacacacccagcctggcttccttcgaccagccagcgaccatacagacggccatggccatcctacaagacctgcgccagcaaatccaggctgggctggagctggcccaggcccgcaagggagggcaagagctcgggccatcaaagcggaggctgcaggacgtggcagggaggggctgctgcagggaccccaatgcccagagctccttctctaagagtccctgggccatgacagagaggaagcattcctctttagagagggctaggagtgtccacacctgggagccctggagctcctccactgcacgggagtcctgtccgcagagggcctggggggcccaaggacaggaccgctccttccagaggccggagagtccccatgagaggttgggccacttctcccagaggccctggagtgcactggctgggcaggcctgcagtccgcagagggcctggggggcccaaagacagggcccctcctcccagaggcctgggagcccccctgaaaagcggagccccttcccccagcagccctggagtgctgtagccacacagccctgtccacggagggcctggactgcctgtgaaacctgggaggaccctggccccagactgcggaaccctctggaaaggcccagtcctccagcccagcggccctggagcagctccggcgtgcagagggccggcccccagggcaagggcagaggcatcggctcccccgtctcggctgccaagcatgccctgccaaggcccaccgggagcttccctcagaacccacttgggaaggagaaggacacgctgcggccctgccccaggtcccgggggctcctgggaccctcgcacagctctgagtccttgcgggagttcatgcgccagaaggcgcaggcccggcggcggcaggccctggaggagaaggcctcggccctgcgcacacgggagctgaggagccggaggctgcaggaggtctaccggcagcagagggaggccgtcctcggcagggcggtccccgtggtctcccggaccacccctggcatcgtgacctttgtccccagttctgcacagtccgggggcctggaagcctccgggagcctggagtccccagtgctggaatggagcaaagtgacctctggcatggtgctggggggccaggaagccccaggcagcttctgcctgtgtttgaacagagcctggaaccatgctgagaccctagatcccccagggatggggggcccccaagatggccgggatgcccccgtgctgctgtcagcttcaccctctctgggatccctggagctccaggacctgaccacccgctacctaccccgggggatgtgcatctacctggacccaaaggaggctgagcacctgggcacttccagctccctgcacctccggcataagcaggcgcagctgcaggcgctagagaccacagccaaagtcctcaagcagcgggtcgatagcctcaccgccaagctgcagggtgccgaagcgctggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggacggcgagacactgtcgtggggccccagctgggagcaacagcagagtgtgagcccgagggcccactgcgagagcaagccccgaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggctttcgggaccctctgcgtgctctgtgctcaccacacctgcagtgatgggccctcggtggatgagacccacgtgcttatttcatgacagccatgccccgtgccgctgtgcccagcccacctcctagggcgcttccttacagtcccatcagctcggattcgactttttcttctgctactgagtgttttcatccggggtttccaacgagcagtgcccactgcctggtgcccaagggacccagcagctgctgaagccctgggcttgagggcctcgtgctggcgtgggctgcgctgtaggaccctcctggctggggggcttggcagggcagctggaggggctggtgcagccatgggaactgagtgtggactcagaagtgggggacccccgtttgccgcttcatcattgtctgttgattttcttcaaaagaacaggttttgagcattgga

SEQ ID NO: 120951 - DNA, 1475 bp, Homo sapiens
  Payload ID: 3706
  Gene Symbol: CCDC188
  Gene Name: coiled-coil domain containing 188
  ENST ID: ENST00000439765
  CDS Start-End: 80-1288
cagccccctcagtaagagggtggcaggttgggccaggccagagcctggacctgggatcaggaaggggttgcagggagggatggaggggctgaaaaccctgggcccctgcggccacccccacccccagtgtcccccaaccccagcctccagcagccatggaggaggcctggaccagccctgccagggatttgtagggtggccctgcctgggccccatctcctctgctcactcagtgcagtcccagagacctttcccagtcccaggggcagggggcagtgggcccacagtggagggcgaggctcccgggctctttctgtccagccaggagcagagagcgagagacactgaggggccgagacaaggagacctggaggcagggcttgggtggggctggcccctgcacccagggtcgaaccagggggctcccaggcaggggggatccattggctcagggaccagaccctgcccatgcccacccctgtcacgggagggaggggccctggcctcgcccagggtagccctgtcccagcttcagtgcgggctgctgggctctgcagaacagtccttcctgcagctggagcaggagaaccacagcctgaaaaggcagaatcaggaacttcgggagcagctgggggccctcctggggccggggcagcagttcctgcccctgtgtcccgaacactcaagctgcactgctctggcctggccccccgacccggctggcacgcagcccttggggaacagggcacctctgcagctgctgcggcgggagctgtgccaggggcaagaggctttcgtgcaacagtcccagaacgagctgcagcagatccgcctgtgctttgagaggaagaagatggtcatcacagaggtgtgggacaacgtggctgagatgcacatggccctgaacaaccaggccaccgggctcctgaacctcaagaaggacatccggggcgtgctggaccagatggaggacatccagctggagattctcagggagcgggcccagtgccgcactcgagccaggaaggagaagcagatggcaagcatgtcgaaagggaggccaaagctgggaagctccaagggcctggcaggccagctctggctgctgaccctgaggctgctgctgggcgccctgctggtctggaccgctgcctacgtgtacgtggtgaaccccacacctttcgaggggctggtgccacccctgctgagccgtgccaccgtctggaagctccgggccctgctggaccccttcctgcgcctcaaagtggacggcttcctgcccttctaggccagaggcccagcggccccagcaaggaggccaggcgaccagcactgccccggatgcccagtggccgtgccagccccctgcacatggcaccactgtgcaccatccttgccagaagctgcagagaagggtggaggtggggtctgtcctgagggctgggcctgtggctggacatagaatcatgacataa

SEQ ID NO: 120952 - DNA, 1967 bp, Homo sapiens
  Payload ID: 3707
  Gene Symbol: CCDC189
  Gene Name: coiled-coil domain containing 189
  Uniprot ID: A1A4V9
  ENST ID: ENST00000543610
  CDS Start-End: 963-1958
aagttctgagggttaaggcaagagcccacgaaccgtggaagagatgcctccaagacgaatgggctcgataagagtcgtggtggtcttctcctcacgactcagcttcttttccgggggccctgagcccccgtcgccggcggcgcgtttgttgcctggcccagacatggccgcggcggctggagcgatgcagggtcccctgaggggcgtcaaacgggaggaggcggtacttccgtcacctgcagaagacacagagcagagatgtgggaacggctggtgttccacagccccaaacaccctccaccctgcacacacctgctggatcccgtcccccccggcgccagagccctcaccagcaggagggtcagcctagcgccgccatcttggatttcaccggacgtcactgggcgtcactggacgccactgccccccccccaacggtgcgcagggcgcaggcgccaaaggcagccccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacggagaaagaagaaagcaaggagatggaggagcaggcagttaccccgcagaaagaggaactagagacagtggccccaccagagccagagccaagccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaaca

SEQ ID NO: 120953 - DNA, 1046 bp, Homo sapiens
  Payload ID: 3707
  Gene Symbol: CCDC189
  Gene Name: coiled-coil domain containing 189
  Uniprot ID: A1A4V9
  ENST ID: ENST00000545825
  CDS Start-End: 331-864
gacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaaccgggcctggcacaagtgaccatgggaagcagaagcaggggatttctgcctggaatatgtcattattagtagcatcatcatacacaagccatcagctttccaatccactgcttccttatctagaaattaaggatacagcacacattttacaggactgttctgagaaataatatatgcaaatatatgcatagtgcacaataa

SEQ ID NO: 120954 - DNA, 488 bp, Homo sapiens
  Payload ID: 3707
  Gene Symbol: CCDC189
  Gene Name: coiled-coil domain containing 189
  ENST ID: ENST00000535476
  CDS Start-End: 1-437
caacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccctg

SEQ ID NO: 120955 - DNA, 1055 bp, Homo sapiens
  Payload ID: 3707
  Gene Symbol: CCDC189
  Gene Name: coiled-coil domain containing 189
  ENST ID: ENST00000545809
  CDS Start-End: 338-553
cctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggagtagggactgaggggggcgtgggaagagctcttggcaaaggctgaggggtcaggttgggaaaacatgaggaatggctgactccaaagcatgtggtgggtgtagggtgatgaaaggaggcccagttgtcactcactcctctctccctcccaagggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaagg

SEQ ID NO: 120956 - DNA, 555 bp, Homo sapiens
  Payload ID: 3707
  Gene Symbol: CCDC189
  Gene Name: coiled-coil domain containing 189
  ENST ID: ENST00000544613
  CDS Start-End: 1-275
gagcagagcctgagggacgccatcaccctggacctcttctgccacgcgctcattttctgccgccagcagggcttctcactggagcagacgtcagcggcttgtgccctgctccaggatcttcacaaggcttgtattgcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccctgca

SEQ ID NO: 120957 - DNA, 1531 bp, Homo sapiens
  Payload ID: 3707
  Gene Symbol: CCDC189
  Gene Name: coiled-coil domain containing 189
  ENST ID: ENST00000541260
  CDS Start-End: 332-1522
ggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcagggtcagttcccctggaacattctggaaactttacccatccccagacaaggtctcacccagtctctctcacattcatcacccttatcttcttgtgaagaccccagtgggctctccttgctcctgttgctgggcttttggaggcaaagccagggctccggaaggtagtcagggttctaattccgagtcaccaccacagcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacggagaaagaagaaagcaaggagatggaggagcaggcagttaccccgcagaaagaggaactagagacagtggccccaccagagccagagccaagccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaaca

SEQ ID NO: 120958 - DNA, 1498 bp, Homo sapiens
  Payload ID: 3708
  Gene Symbol: CCDC190
  Gene Name: coiled-coil domain containing 190
  Uniprot ID: Q86UF4
  ENST ID: ENST00000367910
  CDS Start-End: 122-1030
gtgccaggcaggaatggcctgctaggagatgcagtgagcccccaggacctctccactgcctcctccacccctgtatttcacttggctctccaaattgactcaactccagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagcagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgctctaaagccagatgggaacactggaaaacaaattcccccaaaacacatggaatgtgcaggaagcttcgaaggcgagttcacaaagccaaccttcttagagttgctttcaaaggccagaaatgcccattatctccggcacagggtcccccctgagtctgagaggttgcttagcattggagagatatttgggcatggggaatcctcatcatccagggcaggaaaggagtgtgaaaacagggtgccttctaagtttcttcctctctaaccgtttaacatagcctgacaataacatatgccattattgctaaggaaatgtgttcctcaaatgactatattaagcaatacagagaaaaacaaacaaacataattgaattacaattttattttaaactccctattattttccgggaatataatatttcttgaatgaacaatgctaatatatgaaaaaggagaggaagaatgaatcttctgaaaatattttaagtgatatgtttatgatgtcatcaaaaatatgaatatatattgatgactggacttgggaaaacagtaacagtcttgctttcagggacttcctgtttcctctaggagattctcatggtgccacctgctggcaaaacggcatagctattctctctgttttagtttgatatatagtagtggtaggaataggaatgtgattgtaaataggtactgtaacatggtctataaagaaaatctgctctttaaccac

SEQ ID NO: 120959 - DNA, 1395 bp, Homo sapiens
  Payload ID: 3708
  Gene Symbol: CCDC190
  Gene Name: coiled-coil domain containing 190
  Uniprot ID: Q86UF4
  ENST ID: ENST00000367911
  CDS Start-End: 19-927
ctctagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagcagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgctctaaagccagatgggaacactggaaaacaaattcccccaaaacacatggaatgtgcaggaagcttcgaaggcgagttcacaaagccaaccttcttagagttgctttcaaaggccagaaatgcccattatctccggcacagggtcccccctgagtctgagaggttgcttagcattggagagatatttgggcatggggaatcctcatcatccagggcaggaaaggagtgtgaaaacagggtgccttctaagtttcttcctctctaaccgtttaacatagcctgacaataacatatgccattattgctaaggaaatgtgttcctcaaatgactatattaagcaatacagagaaaaacaaacaaacataattgaattacaattttattttaaactccctattattttccgggaatataatatttcttgaatgaacaatgctaatatatgaaaaaggagaggaagaatgaatcttctgaaaatattttaagtgatatgtttatgatgtcatcaaaaatatgaatatatattgatgactggacttgggaaaacagtaacagtcttgctttcagggacttcctgtttcctctaggagattctcatggtgccacctgctggcaaaacggcatagctattctctctgttttagtttgatatatagtagtggtaggaataggaatgtgattgtaaataggtactgtaacatggtctataaagaaaatctgctctttaaccac

SEQ ID NO: 120960 - DNA, 2605 bp, Homo sapiens
  Payload ID: 3708
  Gene Symbol: CCDC190
  Gene Name: coiled-coil domain containing 190
  Uniprot ID: Q86UF4
  ENST ID: ENST00000367912
  CDS Start-End: 176-799
ccccatggagttctacccctgctcctctggtcaccctcctgatggatccccatggtgccaggcaggaatggcctgctaggagatgcagtgagcccccaggacctctccactgcctcctccacccctgtatttcacttggctctccaaattgactcaactccagaccataaagaagatggagaggcacatggtcaggggacaattgtataagcattttgatttggagaggaagaatgccaagcaggctgaagccagactggaccaaagactgcagagactaaaggttatttgcctctaccatgtgaaattgctgacctgggagcagaggcagctccaaaaagaactgcagaggttgcagcaagaaaccatgaagaaaaagttctcctcttatttggggaatggatttcagaagagaccagaagatgttctcgtgttctcaccacagggaaggcagaagcacagagccccacaggctaagaaaatgagagcattggcaacccgtatggcccaagacacatgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagcctctggccttcaatggggagacaatactttatagtgaaaggaacacaagaaatctgcttcctccaacactttcttccatgaagcaaagcaacagaggaaggcaggccataagtgacagaactgattgattcacaaaaacttaatttatttgcaccagccatgcctgggccaacatgaataggcatacaacaattagagaacccctttgtaaactgcgcaagctctttcctaaaagttctttcttcttgtcttctacgcaagccttgcctatcgtcatcacaattctccctcaaggctgagtcctgagtgaatggtttgtcactgctaagtgggtcttttcactgtactagctctcacagcgggaaggggccatcacaaggcaggagggagccaacttcagcctagttctctgttccaggtccacctcaatcctgccatctacagaagtgaacattctgcatgttcctccttgctatcttgcttgtgtcttcatatacatctgacagacccagatctgtctgcacttctaaaatcaatattttagtacatcctgttttaaataatattccatgcatcgccaaaaaattatacatttaaaaatcttctaaccacctagattttatcttcttatcatttagtctaatacatttgccttcttcgatacaatggatgtaatactctgattagtacaacttaactcaatcaaagagaacgctgctgcatggaacctttcttgtgtaactcattaaattctaaacagtttaaatccttaatcctgacgtggcacacggtgctctaggatggcttgctctcgaccagtccatggccactttacttataccagtggttctcagctaggagcaaatgtgccccctgtccccagaaaacatccagcactgtccagagatatttctggttgtcataactgaggtgagggggctgccactggagtctagtaggtagggaccataaattctataatacatggggcagccctctaaaacaaagaattaacaagcccgaaacatcaatagcgccaagattggaaactccaccctgtgccattacattaaatattcacagaaccttctgagacagaaaatcagggagatacttgctgccattttacagataaagaaattgaggctcatgataagtaaaatagctttctccataccagaatgtggatgaggaacaaagaccagggtactcttttcccatactctcctctcaaagaagatggggaagggcatgtgtccgatggctcctgccctcgttttcagttaagaaatgctttcaaccctacaaatacaaatctttaacattcaaattagtaacacatggttagaagggataatttatacttcaattttgaggaaacattttttattacattcattcattcattcattcattcagagatgtactggggacagatgatcccttccccatttcctcccccatgaggaagaaggggcttttgacttgttgccttaactcattcaatgggaaaagattccatttttcacctacaggcagaggcagctggaaactcccagaagtagaggctcagtctctctggaggctactgaagagcaccctgaagggtgtcacaatcctcagtgttgggggaaagttgggtaagtttttaccatgaacactggagggaccagctcctctcagggtgaaatgagccttgaaggaaggacagagggaatcacgcttgggcaagtgttttgccctcacaccaagagtaccagggaagcagagggtaccagtccaaacagatgtcagcagctctatctcaccaatgacagccagaatagcaagcaaccactgc

SEQ ID NO: 120961 - DNA, 3976 bp, Homo sapiens
  Payload ID: 3709
  Gene Symbol: CCDC191
  Gene Name: coiled-coil domain containing 191
  Uniprot ID: Q8NCU4
  ENST ID: ENST00000295878
  CDS Start-End: 148-2958
gcctcgtgggagtggtggttcgacggtgtcctatgcctgctttccttgcgggcggaggaactacaattcccagcgtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagcctacttttggtcctgacagtgtggaacactggataaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaatagctctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaa

SEQ ID NO: 120962 - DNA, 1957 bp, Homo sapiens
  Payload ID: 3709
  Gene Symbol: CCDC191
  Gene Name: coiled-coil domain containing 191
  ENST ID: ENST00000491000
  CDS Start-End: 129-1957
tcgacggtgtcctatgcctgctttccttgcgggcggaggaactacaattcccagcgtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaa

SEQ ID NO: 120963 - DNA, 2881 bp, Homo sapiens
  Payload ID: 3709
  Gene Symbol: CCDC191
  Gene Name: coiled-coil domain containing 191
  ENST ID: ENST00000460813
  CDS Start-End: 84-329
aattcccagcgtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgtagagctctcaagattgtttagattgaagttctcaaggttgtttagattgaaatcttttagatttggcagtgaaggactctttagtgacttgggtgagggcaattcttgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaaggcagggctgtctcggtggtggccttggtggttgttatcttctctcctagagtagaatgtgtacactgggactgaattctggcaactcttgaggttttgagacttggcagaacctgacatcaaaaatctcagaatggtagacatgtgaggagtggagtacaccagagagccccactacttttttcctgccccttttgccaacctttttggcattcccagccaacacacacacaaaaaaacatagctgaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaaga

SEQ ID NO: 120964 - DNA, 591 bp, Homo sapiens
  Payload ID: 3709
  Gene Symbol: CCDC191
  Gene Name: coiled-coil domain containing 191
  ENST ID: ENST00000483766
  CDS Start-End: 1-591
gtgacccggaggcagcccgggcagaagggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaaagaccctgaaaaaatcggccttcttggaggctcagtgtctggtgcaagaa

SEQ ID NO: 120965 - DNA, 593 bp, Homo sapiens
  Payload ID: 3709
  Gene Symbol: CCDC191
  Gene Name: coiled-coil domain containing 191
  ENST ID: ENST00000463695
  CDS Start-End: 22-138
gttcgggctcgaacttggaaaatgctcctggcgcctcagggaaggtccttctcaaagaaaaggatggggctgaatcgctggaaacggttcacaaggaagccgagtcccaagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatggatctccctctgttgtgcagtggtgatcatagctcactgcagccttgaactcctgggttcaagaaatcctccagcctcagcctccctagtagctgaaactacagatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggtaaaagaaaatcgcttaagacgtgagaaagaactggagtaccagagaatagaaa

SEQ ID NO: 120966 - DNA, 2319 bp, Homo sapiens
  Payload ID: 3710
  Gene Symbol: CCDC22
  Gene Name: coiled-coil domain containing 22
  Uniprot ID: O60826
  ENST ID: ENST00000376227
  CDS Start-End: 171-2054
ctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcaaaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaa

SEQ ID NO: 120967 - DNA, 1463 bp, Homo sapiens
  Payload ID: 3711
  Gene Symbol: CCDC24
  Gene Name: coiled-coil domain containing 24
  Uniprot ID: Q8N4L8
  ENST ID: ENST00000372318
  CDS Start-End: 172-1095
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagcagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggactttaaaa

SEQ ID NO: 120968 - DNA, 773 bp, Homo sapiens
  Payload ID: 3711
  Gene Symbol: CCDC24
  Gene Name: coiled-coil domain containing 24
  ENST ID: ENST00000460543
  CDS Start-End: 167-457
ggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggagcccccaccattccggacactcccctccccagtcgcaaggtatcccagctctccttgcaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagcagcggtcacagagatctcagcatcatcaaggaccaactgaacgtgtccaacattgaccaggtggccagacacctgaggggccttctggaggaggagtgtcacaccttggagagggagatcctcatcct

SEQ ID NO: 120969 - DNA, 1230 bp, Homo sapiens
  Payload ID: 3711
  Gene Symbol: CCDC24
  Gene Name: coiled-coil domain containing 24
  ENST ID: ENST00000463846
  CDS Start-End: 132-311
ggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcaggtgaggacacggagcagggcccagaacacccagcctcctgctcccaccccacacttgtacacaccctagaagagctgggcactgtctcagcccaatctctccttcagagctaaaggaacagaagaaggccatggagcaggagctgcaggcatctgtggggccttcttgtgtctctcccaaccacagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggactttaaaa

SEQ ID NO: 120970 - DNA, 697 bp, Homo sapiens
  Payload ID: 3711
  Gene Symbol: CCDC24
  Gene Name: coiled-coil domain containing 24
  ENST ID: ENST00000466180
  CDS Start-End: 38-697
cgtaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggagaaacagttgcctagaagtgatatttgggtcctgaaggcctggggtgagcaacatgcggagagtgatagtgacttcattgccagcagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaag

SEQ ID NO: 120971 - DNA, 860 bp, Homo sapiens
  Payload ID: 3711
  Gene Symbol: CCDC24
  Gene Name: coiled-coil domain containing 24
  ENST ID: ENST00000486504
  CDS Start-End: 96-293
gggtttggtgagcgttgccggcgggcccgcggtacctcccgcactctgacctgcggcccgtaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaagcagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggacc

SEQ ID NO: 120972 - DNA, 2654 bp, Homo sapiens
  Payload ID: 3711
  Gene Symbol: CCDC24
  Gene Name: coiled-coil domain containing 24
  ENST ID: ENST00000486064
  CDS Start-End: 168-458
ttccgggacagtggaggcgacgaagtaataaacccgtggacccagatttctcaggtcttaacacgttccctgaggcctaaaggtgcccagggccgagcccaaagtgcttgggtcagggctcggtggagcgccgaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggagcccccaccattccggacactcccctccccagtcgcaaggtatcccagctctccttgcaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagcggtcacagagatctcagcatcatcaaggaccaactgaacgtgtccaacattgaccaggtggccagacacctgaggtgaggcccaggggcacctgcatgtgtataggcaggggtggagacaaggatggatcttgaggtgctgggattgtgagacaggaggtgggtagtatacttggcggggaggcccatgtgcgtaaggctgagaggtggaaagagctggctgctatagagctagtgaggttgctttcaggaagcagccaagtacagatgccacggccgagcatgatggtgcatgcctataatcccagcaatttgggaggccgaggcaagagggtcatttgggcccaggaattcgaaaccagcttggccaacatgggaaaaccccatctctaccaaaacaaatacaaaaattagctgggcgtggtggtgcacgcctgtaccagttacttgggaggctgaggtgagaagggattgattgagccctggaaggtaaggctacagtgagtcatgatgggtggcagagcaagaccctgtttctttctttctttctttcttttttttttttttttgagatggagtcttgttctggcgcccaggctggagtgcagtggcgtgatcttggctcactgcaagctccacctcccgggttcacaccattctcctgcctaagcctcccgagtagctgggactacagatgcccaccaccatgcccagctaatttttttgtatttttagtagaggcggggtttcactgtgttagccaggatggtctcgatctcttgatctcatgatccgcccatctcagcctcccaaagtgctgggattacaggcatgagccacctcgcctggccgaccctgtttcaaaaataaataccttgacacaggggtagcctgtgtcagaggattttaagcagcggaagggctgtgatgtgggggaagatggaggcaagaagaatcacagtgcagaagtgtgggagagagaaggatgcctgccagggtgaggcaggcgaggggaagatacttcctgcccagaaagagcctcacaggggccagacgtctatgctgggtcagcccccaagcagcagagggcagtgtgggctgaggaaggacaggttgggtggggctcctgctgaggctggaggttggggccatgtggtggactcagctgagccctggtcctgtgtctcgggttctggctgctgctccctcatgtcccaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttt

SEQ ID NO: 120973 - DNA, 728 bp, Homo sapiens
  Payload ID: 3711
  Gene Symbol: CCDC24
  Gene Name: coiled-coil domain containing 24
  ENST ID: ENST00000490064
  CDS Start-End: 106-285
tagaggggcggggtttggtgagcgttgccggcgggcccgcggtacctcccgcactctgacctgcggcccgtaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccag

SEQ ID NO: 120974 - DNA, 3626 bp, Homo sapiens
  Payload ID: 3712
  Gene Symbol: CCDC25
  Gene Name: coiled-coil domain containing 25
  Uniprot ID: Q86WR0
  ENST ID: ENST00000356537
  CDS Start-End: 95-721
gggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcatgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcactttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtagaactgtg

SEQ ID NO: 120975 - DNA, 3586 bp, Homo sapiens
  Payload ID: 3712
  Gene Symbol: CCDC25
  Gene Name: coiled-coil domain containing 25
  ENST ID: ENST00000520486
  CDS Start-End: 114-242
aagtgcacggaggagttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcatgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctgtgttgattcctatgcccctaaccctgcagcctctttgttttatttttttccccatctctgttggtcccagggaaagcaaggaaattttcttttgaggacttataggttgattgcccacaggtcaaactgttggcattgaactcctctcatttcttgccattggattgtttcctaaacgttggataggagaattcgaaattgttgctatttttatgagctgtgcccttgatcaaatctgtgctgtgggtctgagtcactttgccaatgtcgtcttcagtttcaacactctgatcagcatgcaggcgaggggcatgtttaatttacttcactaactgctatattctatagctttagacttcatatttcttatccacctttgtctaggctcacgatctttgggcaagggagctttgtcaccgtggttgggctagaacaaatattgagaagtttaccaacacagatgttgagaagtttattgaaaggcactgacattagcagaataagtgatggacattagttgaaccccttcagtgtctatgtgttttattgtattgtctttaactcgttcttgaagcacagatttcagcgagcctttcagctattcagtgccagcggttttccccactcaggaaagatggtgtgagccatacacacagcaggattagacggggagagtttcagctgcagcttctagtttaagaccaaagcccttcctcccgctgctgcatctgtctgagaggggaagctcttgttttccaagctggaaccgtttatgaggaaaactgagcagggtggcaaaatggaaaaggaacaattttctagtttttcctacgcgtgatattgacgcgtgctttttctttgatttgaggtacagcatgtaaataacaaatttccatattcaaaatgatcatattagagtgactgagtgaccttttgattttgaagcagactaaaatctgaccagaccacaatgaaaagtataaaattagaaacttaaattccaagctaaatttcagctttgacccacctaactccagtgaataggtggcagctcagaaacaaggacagcactgctgctgccagagcaagctcacatccagctggcacttcgtgagagctccttcctgccgggcacgtgtgagttcagcgtgggcaagagacttttatgcacattctgtcattcaaaagggaaatgatgccaaccccagatgcagcatgtcctgaatgaatgatctgtaaaatacaataataaaagcttatagtttgagtag

SEQ ID NO: 120976 - DNA, 785 bp, Homo sapiens
  Payload ID: 3712
  Gene Symbol: CCDC25
  Gene Name: coiled-coil domain containing 25
  Uniprot ID: Q86WR0
  ENST ID: ENST00000522915
  CDS Start-End: 199-621
gggggccaggcggccgccgcgagtctggtatcctgagcttcgtgagttgagcgctgctgctccgcggtggagtcaccgcaccgctcccgggatcatggtgttctacttcaccagcagcagcgatgaagatctgatcaagcatggctggcctgaagatatctgggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtacctttttt

SEQ ID NO: 120977 - DNA, 877 bp, Homo sapiens
  Payload ID: 3712
  Gene Symbol: CCDC25
  Gene Name: coiled-coil domain containing 25
  ENST ID: ENST00000517979
  CDS Start-End: 74-154
agtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaagctgaggcgagaggatcacttgagcccaggagttcgagacctgcctgagcaacatagggagaccctgtctctacaaaaaacaacaataaaagaaaatattagctgggcatagtgacacacacctgttgtccttgctactctggaggctgaggcaggaagatcgcttgagcctgggaggtaggctgcagtgagctgtgatcatgccactgcattccagcttaagagacagcgagaatctgttgtctgaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggctgcaagatgaacaacgttaatgtggtatatacgccgtggtctaacctgaagaaaacagctgacatggatgtggggcagataggctttcacaggcagaaggatgtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggtatg

SEQ ID NO: 120978 - DNA, 977 bp, Homo sapiens
  Payload ID: 3712
  Gene Symbol: CCDC25
  Gene Name: coiled-coil domain containing 25
  ENST ID: ENST00000519509
  CDS Start-End: 101-379
agttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacag

SEQ ID NO: 120979 - DNA, 1734 bp, Homo sapiens
  Payload ID: 3712
  Gene Symbol: CCDC25
  Gene Name: coiled-coil domain containing 25
  ENST ID: ENST00000520202
  CDS Start-End: 100-228
gttccgggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctgggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggagctattcatcactaatgaaagttgaaaatatgtcttcaaatcaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcatgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaa

SEQ ID NO: 120980 - DNA, 460 bp, Homo sapiens
  Payload ID: 3712
  Gene Symbol: CCDC25
  Gene Name: coiled-coil domain containing 25
  ENST ID: ENST00000524084
  CDS Start-End: 88-348
aggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggagctattcatcactaatgaaagttgaaaatatgtcttcaaatcaggatggcaatgattcagatgaattcatgtaaaaggagaaaaggagaaaaggacctttgaaagatgtgaatgtagagacaattgc

SEQ ID NO: 120981 - DNA, 947 bp, Homo sapiens
  Payload ID: 3712
  Gene Symbol: CCDC25
  Gene Name: coiled-coil domain containing 25
  ENST ID: ENST00000523841
  CDS Start-End: 68-346
gtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctggcctgaagatatctggtttcatgtggacaaactctcttcggctcatgtataccttcgattacataagggagagaatatagaagacatcccaaaggaagtgctgatggactgtgcccaccttgtgaaggccaatagcattcaaggtaaaaattgtgacagtggagaagaaagtaaatgagatcctgaaccgattagaaaagaccaaagtcgagcggttcccagacctagcagcagagaaagaatgcagagatcgtgaagagaggaatgagaaaaaagcccaaattcaggaaatgaaaaagagagaaaaagaagaaatgaagaagaagagggaaatggatgaacttaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgtta

SEQ ID NO: 120982 - DNA, 2176 bp, Homo sapiens
  Payload ID: 3713
  Gene Symbol: CCDC27
  Gene Name: coiled-coil domain containing 27
  Uniprot ID: Q2M243
  ENST ID: ENST00000294600
  CDS Start-End: 85-2055
gtgatgccaccactgctcccaggagcccacaggacctggagctctggaagctgatctcctcccactgcaccagccagcaggttcatgttcgaggccatcttcccctccacaccccaagccaggctgaagagagatccacgggaaaagccgggcctgtcctcattcaggtccacattcaggcaacaaagctcacttggtctttgcatcccacgcctcatgttacctaaggaggccagcccatctcagaggcacagttcgatgtccagctcgatggccagggccctggtgctcctccagagcatggccagccgggacgcccggtgcccagaatggaaaccgcaccaaaagccacgcacgctcagcaagtcggtccagaccatcagccgctactacaggaagacgagtgaacccaaggatgccgccagcctcaccggcttcatgtccaaaatggaacttcgaagggtcttccccacgcatcctgactgcccccagttcagcaccagggccacatccatgtcccactgtggttcacccactgaggccgatttgtccggagagattgacaacagctcggagacctggagaggcacccaggacctgttcttggccaggcggggctcagacacgaacgtggacgggtacctccttcccttcagtaagagcatctgcgagttcgattacttgcggaagaggagaaaatcccagactttgagtccggtcaccagcagctcagtcgcatctcagagctgcctgagaaagaggatgccctggtacctctcagtcatccacgagaaggatcactgcctgtctgagctggagatacaggttcagaagaaagacgaggagatcctgctgctccaggaggagagggaggccctgaagatgcagctgaaatgccttctgaaaggcaaaggccaagagacatccatgtccccaggcaggagggagcagctctcagacgcttcgctgaagctgggcaggctgagcctcctgaaggccttctccagacatgaggaggagctgcagcactggtggcagatgcaggaggagtctgcggcaccggagaggggcaaggagcccgacctgggaggtggcgaggaggacgagggcctggaaggggagcccgatggggtggaggacacgggtgcctggggaggtgtgagccagatgggatccgtgcatgaggagggaagcgaggaggaggaagaggaggaaggggacagggatgaggactcagaggaaagggagctgccggaggaagaggagatccccaggagaagggcctcctccctggccgagtcgtttgaggaggagctgctggcccagctggaggagtacgagcaggtcatcctggacttccagttcaacctggaggccaccaggaccagatactcccttgcaacaggagtgattgcgtctttacaacaacaagtggatttccaagaaacccagctgcgaaagatcaatacggaaaatgagacgctgcagaaggagctccgagagcggaggcagcagctacaagccatgaccgacaagttctccaacctccgagaagataagaaacaccaagagatgatggggctcattgaaaaggacaaccagctcctccgacagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccaggctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgt

SEQ ID NO: 120983 - DNA, 2252 bp, Homo sapiens
  Payload ID: 3713
  Gene Symbol: CCDC27
  Gene Name: coiled-coil domain containing 27
  ENST ID: ENST00000462521
  CDS Start-End: 38-646
aagctgatctcctcccactgcaccagccagcaggttcatgttcgaggccatcttcccctccacaccccaagccaggctgaagagagatccacgggaaaagccgggcctgtcctcattcaggtccacattcaggcaacaaagctcacttggtctttgcatcccacgcctcatgttacctaaggaggccagcccatctcagaggcacagttcgatgtccagctcgatggccagggccctggtgctcctccagagcatggccagccgggacgcccggtgcccagaatggaaaccgcaccaaaagccacgcacgctcagcaagtcggtccagaccatcagccgctactacaggaagacgagtgaacccaaggatgccgccagcctcaccggcttcatgtccaaaatggaacttcgaagggtcttccccacgcatcctgactgcccccagttcagcaccagggccacatccatgtcccactgtggttcacccactgaggccgatttgtccggagagattgacaacagctcggagacctggagaggcacccaggacctgttcttggccaggcggggctcagacacgaacgtggacgtaagagcatctgcgagttcgattacttgcggaagaggagaaaatcccagactttgagtccggtcaccagcagctcagtcgcatctcagagctgcctgagaaagaggatgccctggtacctctcagtcatccacgagaaggatcactgcctgtctgagctggagatacaggttcagaagaaagacgaggagatcctgctgctccaggaggagagggaggccctgaagatgcagctgaaatgccttctgaaaggcaaaggccaagagacatccatgtccccaggcaggagggagcagctctcagacgcttcgctgaagctgggcaggctgagcctcctgaaggccttctccagacatgaggaggagctgcagcactggtggcaggcagatgctctcccactccctggaccctgcagcagcctggaaggaggcgccctccccggtgcccccgccatgagcattagagccctctgccctgggggtgccccgcagccctgcccagcccctgccctacccatcttacagatgcaggaggagtctgcggcaccggagaggggcaaggagcccgacctgggaggtggcgaggaggacgagggcctggaaggggagcccgatggggtggaggacacgggtgcctggggaggtgtgagccagatgggatccgtgcatgaggagggaagcgaggaggaggaagaggaggaaggggacagggatgaggactcagaggaaagggagctgccggaggaagaggagatccccaggagaagggcctcctccctggccgagtcgtttgaggaggagctgctggcccagctggaggagtacgagcaggtcatcctggacttccagttcaacctggaggccaccaggaccagatactcccttgcaacaggagtgattgcgtctttacaacaacaagtggatttccaagaaacccagctgcgaaagatcaatacggaaaatgagacgctgcagaaggagctccgagagcggaggcagcagctacaagccatgaccgacaagttctccaacctccgagaagataagaaacaccaagagatgatggggctcattgaaaaggacaaccagctcctccgacagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccaggctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgtc

SEQ ID NO: 120984 - DNA, 1496 bp, Homo sapiens
  Payload ID: 3714
  Gene Symbol: CCDC28A
  Gene Name: coiled-coil domain containing 28A
  Uniprot ID: Q8IWP9
  ENST ID: ENST00000332797
  CDS Start-End: 156-980
ggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaa

SEQ ID NO: 120985 - DNA, 1505 bp, Homo sapiens
  Payload ID: 3714
  Gene Symbol: CCDC28A
  Gene Name: coiled-coil domain containing 28A
  Uniprot ID: Q8IWP9
  ENST ID: ENST00000611852
  CDS Start-End: 167-991
actcaccgaggggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaatt

SEQ ID NO: 120986 - DNA, 1226 bp, Homo sapiens
  Payload ID: 3714
  Gene Symbol: CCDC28A
  Gene Name: coiled-coil domain containing 28A
  ENST ID: ENST00000610978
  CDS Start-End: 227-712
cggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaatt

SEQ ID NO: 120987 - DNA, 1240 bp, Homo sapiens
  Payload ID: 3714
  Gene Symbol: CCDC28A
  Gene Name: coiled-coil domain containing 28A
  ENST ID: ENST00000617445
  CDS Start-End: 177-731
gtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgtttt

SEQ ID NO: 120988 - DNA, 1089 bp, Homo sapiens
  Payload ID: 3715
  Gene Symbol: CCDC28B
  Gene Name: coiled-coil domain containing 28B
  Uniprot ID: Q9BUN5
  ENST ID: ENST00000373602
  CDS Start-End: 348-950
aaagccaccaccattttgtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 120989 - DNA, 1415 bp, Homo sapiens
  Payload ID: 3715
  Gene Symbol: CCDC28B
  Gene Name: coiled-coil domain containing 28B
  Uniprot ID: Q9BUN5
  ENST ID: ENST00000421922
  CDS Start-End: 101-826
gtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatgtatcctttccaaggaacccgtctatgtgtgtgtgttcctgagaggtcagtttcctcctctccagccctccaggagtattcacacacaaccaacttccccacctcttgcagtcctgtcagatttagccacagactgcccaaacccaggtacaggaatttagaatttccccaaaattagaagaaaagtggttgtaggggatgttttactactgatcaaaatctttgtgagtactttagctgacatcaatcatagcaaagcttgtccgatgtcctcctatcctttcagcattgaacaattatttttactaatttacactaccacctcacctggtcctcagtcagaaacagcgcgagtgcgcgcgcacacaccccagtgtgtctgacctgcacgatctggatgaagagagagggggtgagagagggcaggcggggactgcaacctcagtccacagacggcccgagaccctcgtccccggccctttgcacaggtgagggaactaaacctgtgcaagatgggagaccggggtgggaggaaggactggtccaaagcgccacgatccttgacgggcacagccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 120990 - DNA, 780 bp, Homo sapiens
  Payload ID: 3715
  Gene Symbol: CCDC28B
  Gene Name: coiled-coil domain containing 28B
  ENST ID: ENST00000461819
  CDS Start-End: 90-479
gggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaa

SEQ ID NO: 120991 - DNA, 1235 bp, Homo sapiens
  Payload ID: 3715
  Gene Symbol: CCDC28B
  Gene Name: coiled-coil domain containing 28B
  ENST ID: ENST00000469003
  CDS Start-End: 133-384
aaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagacccctgagaactcagagctcactcagacccagtccctaccctcaactgtgtggcaaaaaggccaggtgggtcactgggatcacatagcgtgaggattcgcctcagaggagggagtgagcaactctgcaagaaagtgaatgttccacgctgagaggcttacctggtataaatatggaagaaagctattacctgaaaggtttcaggaaccacaggtggtttgggggccctggagtatcagggaacaggaaatggtgaggaaatacctgggggcacaatttgaattctctgttgaattttttttatgattgggagtttgcatgctgccttataatgtgtccatgtttgttccccactaaatacaatgtattctttctccagttgctccagataagaccactgtgtttccccctggttttgcacaccacttgcctaaggggcatgaagctcaaggctgtggggagagtagcaggaaaggcaactgggaaggcaggagggccaggctggcaggggcattcaattttatcctgagagcagtggaaattttaagacagtttttttggtttattggtttggctttgttttctatgtatttttgtttttgtttaaaagagtttttaaatagaagagggttggctgggcatggtggctcagcctataatcccagcacttggggacgctgaggcaggcagatcacctgaggtcagaagtttgagaccagcttggtcaacatggtgaaacctcatctctgttaaaaatacaaaagttagccaggcgtgatggtgggtgcctataatcccagcaacttgggaggctgaggcacaagaatcacttgaacctggaaggcagaggttgcagtgaaccgagattgtgccactgcactccagcctgtgtgacagtgagactctgtctcaaacaaaaaaaaaattttttttttaatt

SEQ ID NO: 120992 - DNA, 2731 bp, Homo sapiens
  Payload ID: 3716
  Gene Symbol: CCDC3
  Gene Name: coiled-coil domain containing 3
  Uniprot ID: Q9BQI4
  ENST ID: ENST00000378825
  CDS Start-End: 128-940
cggagacagcggtgcgctcagctcccgggagcggcccgagcagccgagcgcccagggctgcccttcccgggccggcgggctccccgggctccccgccgccgccccgtgcgccccgggagggcccggcatgctgcgccagctgctgctcgccgcgctctgcctggcgggtcccccagcgcccgcgcgcgcctgccagctgccctccgagtggaggcccctgagcgagggctgccgcgccgagctggccgagaccatcgtgtacgccagggtgctggcgctgcaccccgaggcgcccggcctctacaaccacctgccctggcagtaccacgccggccaggggggcctcttctactcggccgaggtcgagatgctgtgcgaccaggcgtggggcagcatgctggaggtgcccgccggctccaggctcaacctcaccggcctgggctacttctcgtgccactcccacaccgtggtccaggactactcctatttcttcttcctcaggatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaatgcccgggggcccgtgcgccccccctacctgcgggggtaacgggcctgggggctgccaggtgtgcagggccaatcctgacggtaattgagaatgagtgaggtttcgtacatgcagctatttcaagggttgtaagagtttttgtttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagaccccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccacaa

SEQ ID NO: 120993 - DNA, 3180 bp, Homo sapiens
  Payload ID: 3716
  Gene Symbol: CCDC3
  Gene Name: coiled-coil domain containing 3
  Uniprot ID: Q9BQI4
  ENST ID: ENST00000378839
  CDS Start-End: 954-1391
aatacactcaaaaagcagaaagcctgcaggatgcttcttgggctcttgttgcggacgaataggctcggctattcttgttgctgaagaatagcctctgctggtgtggaggagggaagctgcccccggattagacagcaggatgacaaggaaaaaggcagatgcgccctctcctggtatctccgaaggattctgcttcgctgtctggacctcctgctgcctggccaagcctgactctcaaccctgcccctgaggctaaccccaagagcagggcagagaagcaagcaagtcagcgactgccccagacccaattccgggccctcgagttggtgtggtgtaggaggggcagatgaggctagaggctgctttataaggagcagaaaagacggtgtcacagctgtaccctgggatcggcagaaaagggtccccccggggcctgtaaggggtgcctgcgtaacaggtgacttgaatttcaagtgattatcatataaatggaggattagaaaagagacaccaactctggaaccagttcaatggaattcttcaagagactgtaacttagtgcttacaaagacttggaatgatctacactgcatggtgtacctgttagaggaggtgacatcaaagctttaggtactgagagaggatacttcctactgtggaagggaagaaaagaaaaaagcaaagctacttcttggaagagcagtggagagaaaaatattgtttctttttcttgggaaattggcagaggcatgctgaagaaatcagctacagctgttctccacacctggataaatttttaataagaacttaacacacccgccctccagaaagggtggtctgaggtgtcgatggtgttgtctctcccagggctcttctgggcagccttctctgtgacctggagagcgaagagtctatttccatcacatttcagctgccaaactcccctttaaacgatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaatgcccgggggcccgtgcgccccccctacctgcgggggtaacgggcctgggggctgccaggtgtgcagggccaatcctgacggtaattgagaatgagtgaggtttcgtacatgcagctatttcaagggttgtaagagtttttgtttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagaccccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccac

SEQ ID NO: 120994 - DNA, 3098 bp, Homo sapiens
  Payload ID: 3717
  Gene Symbol: CCDC30
  Gene Name: coiled-coil domain containing 30
  Uniprot ID: Q5VVM6
  ENST ID: ENST00000342022
  CDS Start-End: 111-2462
attgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaatggatttctcaagtttgtttgatatcctcagatgccttgtattgaccaaaatattgactttagttcaatgatttatttaggtttctcttcagcagagcacatgtagggttaattcaacattctttcccattatcatgggtatcttttctgatttattttttaacagtaaaaacaatacagtcacattaaagcaaattttgtttttaaaaaaaccctcctatgctgggcgtggtggctcacgcctataatcccagcactttgggaggctgaggtgggtggatcacgaggtcaggagatcgagaccatcctggctaacacggtgaaaccctgtctctactaaaaatacaaaaaaattaaccgagtgtggtggcgggtgcctgtagtcccagctactcagaaggctgaggcaggagaatggcgtgaacctgcgatagcaccactgcactccagcctgggtgacagagtgagactccgtctc

SEQ ID NO: 120995 - DNA, 2664 bp, Homo sapiens
  Payload ID: 3717
  Gene Symbol: CCDC30
  Gene Name: coiled-coil domain containing 30
  Uniprot ID: Q5VVM6
  ENST ID: ENST00000340612
  CDS Start-End: 1-2352
atgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaatggatttctcaagtttgtttgatatcctcagatgccttgtattgaccaaaatattgactttagttcaatgatttatttaggtttctcttcagcagagcacatgtagggttaattcaacattctttcccattatcatgggtatcttttctgattt

SEQ ID NO: 120996 - DNA, 3063 bp, Homo sapiens
  Payload ID: 3717
  Gene Symbol: CCDC30
  Gene Name: coiled-coil domain containing 30
  Uniprot ID: Q5VVM6
  ENST ID: ENST00000428554
  CDS Start-End: 559-2910
atttcagtatcataatgaagacctggaaaaagacaaaacatcacaaaactgcctaggaagaggaatggaacaagtagcaaagaagttaggggtggctcatgaagagattcaaaggctcactgatgaactacaagtgaaggagaaggaacaatgtaaattagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgt

SEQ ID NO: 120997 - DNA, 3653 bp, Homo sapiens
  Payload ID: 3717
  Gene Symbol: CCDC30
  Gene Name: coiled-coil domain containing 30
  ENST ID: ENST00000477155
  CDS Start-End: 2050-3495
gggacgctcgcggcaccctccgcaggaaaatttccgacttggttcttgaggttcctgcctcagccccaaggaggaaagcacccattctcccctcttttccgcattacgggccttttctgcttctccccagtatggtccgaaactacaggaggggaacccctcctggcccggcctttctattccctggctggagtgattccgcctgaaggagaattcgcccgttttccccggacccagctgccacaagcatttagtattaggctgccgcttattattagagcgggcttagaacatcctcagcgagggaaaagttcagttagaagacatacttcaccatcttgaaaaagaagaaatcaatccccttgctactacagaagaacaactctgtttggtgcttattccagccagcacagtgaagacaggctgaggactgctaccacagatgtagaagagcttatagtgaagcacatgggtgaaacaaaagaagttggagtgctggagtgcagtagcatgatctccgttcactgcagcctcaacctcctgggctcaagtaatcctcctgtcttgtcctcccaaaatgctggaattacagtatcataatgaagacctggaaaaagacaaaacatcacaaaactgcctaggaagaggaatggaacaagtagcaaagaagttaggggtggctcatgaagagattcaaaggctcactgatgaactacaagtgaaggagaaggaacaatgtaaattagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagagtgactgaactggaaaatgtagatgagaagaactactgttctggtttttccatccttcaaaagaagctaaaacttttgggcctttgtcctcttggtaaaactggggtgcatctcttgtatacagtatctctgttttgcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaa

SEQ ID NO: 120998 - DNA, 2559 bp, Homo sapiens
  Payload ID: 3717
  Gene Symbol: CCDC30
  Gene Name: coiled-coil domain containing 30
  ENST ID: ENST00000471390
  CDS Start-End: 83-268
acaccatctccagagtcgttggtggctacccatgctaagtcattagtcctctttgcttactgctggctggcagatcctgaaaatgagccaagaaaaaaatgaaatgtttgaaagtgagtggtcaaaagagagagagagagagaagcagttggcatctggtcttgacactgcagagaaggccttgaaagttgaaagtgagagtcatgggcttatcgctcgttttaacttcttgtcctgccatcttggaaagatctatcaggagacataatcagcctatattatgaaaagagacctggaagaattgcaaaaatcaaagtcagagcttatatgcctttataatgaagttcacaatcttccaggggaatcagaaagcaaagaccattttttaatagcatgtgacctgttacaaagagagaattctgaattagaaacaaaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctgaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaatgga

SEQ ID NO: 120999 - DNA, 1566 bp, Homo sapiens
  Payload ID: 3717
  Gene Symbol: CCDC30
  Gene Name: coiled-coil domain containing 30
  ENST ID: ENST00000509712
  CDS Start-End: 433-1371
acagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacaggaaaagcctcaagatttcttgatggtgtttggcagccaggtgatggtgatagcaacaagtattaactgaaggatcattttcagcataggaattaagtgaactgagtgctgtagtcagcagattgaggcttccatgttagagcctgaattatcagtaacataggaagatagaagagaaaccagtacaaaagatcaagagacaaagtacaagatttgaatgagatcctgaaaatgagccaagaaaaaaatgaaatgtttgaaagtgagtggtcaaaagagagagagagagagaagcagttggcatctggtcttgacactgcagagaaggccttgaaagttgaaagtgaggtcttgaagctttcacaagaatttgcacaattaaatcattttactctagggggaaaaactgcaccttctaatttaattacaagtgaaaatacctgtaaagatcctgaatctaatgaaccaattttggaaacagaaattcaaagccgaaaggaagagacagaggaactctgtcccaaattaggagaaagaaagcagaaggaaattccagaggagtcagtaaaggagggcagttttccaagagaggggcagaaggaggagggctcacaacagaatcgagatatgaaagatgaagaaaaagaacagcagttaaccatgaagcctgaggaaattgtgaggcttagagaagagctgagccatataaatcagagccttcttcagtctcagagctctggggatagttcagatgacagtggtgcccagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagtgttattcatgaatctagccacactgtggagaaactaggtgcactcacaatgctgttgggagtataaattggtctaatacctgtggaggcagtttggcattatctatcaaacaaacaaatactcagcttcctgagtagctgggactacagattttggacctgcagcggaaattagaacatgctcataaagtctgtctcacagacact

SEQ ID NO: 121000 - DNA, 2445 bp, Homo sapiens
  Payload ID: 3717
  Gene Symbol: CCDC30
  Gene Name: coiled-coil domain containing 30
  Uniprot ID: Q5VVM6
  ENST ID: ENST00000507855
  CDS Start-End: 569-2287
gaaagacaattacaagatcagataatcagggatagggctaaatatagggtgcagtaggaactctaagagagaagtctgggaaaattccctgaggagctgacatttaagcagaaactcctaggacagtagccaggtgaaagaaagtgttccagagagagagagtcatttgaaatttgattattatactaatcatttgttccttatacaaatattttatttctttttttagattctgcacttaagaaggctcaactagaaattgacaaattgaaggaaaatttggtaaagctgaaagaaaatgatgcagctgacctacagaaagcaaaggaacaaaatcagagactggatgaggaaattctggctttaagaaatagggttcgatcacttgactcagaaaaaaaggtgcttggtgaaatggttgaaagacttaaaggagaggtgtgtgaatctcaagagaataagcaacttggaaaccactcccctggaaaaactgtgggtggtgaacagagagaacagtagagacggggtttcaccatgttagccaggatggtctcaatctcctgacctcatgatccacccgcctcggcctcccaaagtgctgggattacagcatccatcatctggagaaaaactaaaatacaaccagcaaggggaagtacaacaacttcaccagaatttgcaccggctccagattctatgcaactcagctgaaaatgagcttcgatatgaacgagggcagaacttggacttaaagcaacataatagcttacttcaggaagaaaacattaagataaagattgaactaaagcatgcccaacagaagttattagacagcacaaagatgtgctcttcactcacggcagagtacaagcactgtcagcagaaaatcaaggaactggagttggaagtacttaaacacactcagagcattaaatcacagaacaacctacaggaaaagctggttcaggagaaatctaaagttgctgatgcagaggaaaagattttggacctgcagcggaaattagaacatgctcataaagtctgtctcacagacacttgtatttcagagaagcagcagctagaggaaaagataaaagaagcaacacaaaatgaagctaaagtaaagcaacaatatcaagaagaacaacagaagaggaaacttctatatcagaacgtagatgagttacacaggcaagtgagaaccttacaagataaagaaaatctactggaaatgacctgttctcagcaacaatccagaattcagcaacaagaggccctacttaaacaactggaaaatgaaaaaagaaaatatgatgagcatgtcaaaagcaaccaggaattgtcagagaagctatctaagctacagcaagagaaggaagctctacgtgaagaatatttgcgattattgaagctgcttaatgtccatgtgagaaactataatgagaaacatcaccaacaaaaagtcaagcttcaaaaagtcaagtatcgtttaactaatgaagtagaactacgagataagagaattaaccaatttgaagatgaaattggaatcctgcaacataaaatagaaaaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggagagaatcttaaggagtttcctgttccaaaatggtggcatagaggcaagctggcttctctccctccaacaaagaaacagaaagaaatatacagcactgaggtcttcaccagcaacaatgcagaactccagcatgaggatgagtcagttcctgaggccacagagaagtggaaacactctgagcagatggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaa

SEQ ID NO: 121001 - DNA, 2093 bp, Homo sapiens
  Payload ID: 3718
  Gene Symbol: CCDC33
  Gene Name: coiled-coil domain containing 33
  Uniprot ID: Q8N5R6
  ENST ID: ENST00000268082
  CDS Start-End: 21-1124
caggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtggaccccggggagttgggagcaggaggagacttgacagagaggctacaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtga

SEQ ID NO: 121002 - DNA, 1450 bp, Homo sapiens
  Payload ID: 3718
  Gene Symbol: CCDC33
  Gene Name: coiled-coil domain containing 33
  Uniprot ID: Q8N5R6
  ENST ID: ENST00000321374
  CDS Start-End: 50-1051
aacagtccctggggacccatcctggggaacaggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcct

SEQ ID NO: 121003 - DNA, 2787 bp, Homo sapiens
  Payload ID: 3718
  Gene Symbol: CCDC33
  Gene Name: coiled-coil domain containing 33
  Uniprot ID: Q8N5R6
  ENST ID: ENST00000398814
  CDS Start-End: 432-2699
agtgttgcccaggtgacccagctaggtggaagagcttattgttttccaggcctgggcagagacagggcccccctgccccatctctccaccgtcctaggtgtgccaagagtcaattgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgaaaagcacatctgaggaaaagaacaatcagagctccaaggcagtcacatctgtgacctcagagcccaccagagcccctatctggggggacacggtgaatgtggagatccaagctgaggatgcagggcaagaagatgtgatcctcaaggtggtggacaacagaaagaaacaggagttgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctcgcgtcagccagaacggatgccctcagctgtccaagcctgggggacccccagagcagcccctgtggaatcagtccttcctcttccaaggccgagatggagctaccagcttctcagaagacacagccctggtgctggagtactactcctcaacttcaatgaaaggcagccagccgtggaccctcaaccagcccctgggcatctctgtgttgccgctaaagagccgtttgtaccagaagatgctgacagggaaaggcttggacgggcttcacgtggagcggctccccatcatggacaccagcctgaaaactatcaatgatgaggcccccacagtggctctctccttccagctgctttcctctgagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtga

SEQ ID NO: 121004 - DNA, 1993 bp, Homo sapiens
  Payload ID: 3718
  Gene Symbol: CCDC33
  Gene Name: coiled-coil domain containing 33
  Uniprot ID: Q8N5R6
  ENST ID: ENST00000558821
  CDS Start-End: 32-1033
atcctggggaacaggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgta

SEQ ID NO: 121005 - DNA, 2119 bp, Homo sapiens
  Payload ID: 3718
  Gene Symbol: CCDC33
  Gene Name: coiled-coil domain containing 33
  ENST ID: ENST00000558659
  CDS Start-End: 1-2104
gttgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctcgcgtcagccagaacggatgccctcagctgtccaagcctgggggacccccagagcagcccctgtggaatcagtccttcctcttccaaggccgagatggagctaccagcttctcagaagacacagccctggtgctggagtactactcctcaacttcaatgaaaggcagccagccgtggaccctcaaccagcccctgggcatctctgtgttgccgctaaagagccgtttgtaccagaagatgctgacagggaaaggcttggacgggcttcacgtggagcggctccccatcatggacaccagcctgaaaactatcaatgatgaggcccccacagtggctctctccttccagctgctttcctctgagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtggaccccggggagttgggagcaggaggagacttgacagagaggctacaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttctttcaa

SEQ ID NO: 121006 - DNA, 2109 bp, Homo sapiens
  Payload ID: 3719
  Gene Symbol: CCDC34
  Gene Name: coiled-coil domain containing 34
  Uniprot ID: Q96HJ3
  ENST ID: ENST00000317945
  CDS Start-End: 41-730
tccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaagtaaggaggggaaaatggatacacacattgacatctcttttgcaaaatatttcttcctattatacttcattacctaggttttaaaaaatacttctcttagagtctttcttctttggcttgttttgtttttctatcctggtggacatttatcaagtctctatcttctgccctttgccctctacttttctcctttttccctcctgtggcttgcactaatatttgcctgcaggcagtcaccaagtctgtatttctaggcctgaccttttggatccttatggcaagtgcctccaagtctgcaaatctaaaacaacccattttgcccatttctccttcgtaaatccatcctcccatttctctgtttcattcagctgtcttctcggtcatcaaggcttaattagaattcttctgttgttcctaatcatctcctccttttctttacaattactactcccctgtttgtgatctctttccattatatctttcaacttgttgtttacttcttatactggattgtaagctacataagggcagggatttttgcctcttttgttcagttttccaggagctagatgaatacctgcgcatgatatatgtccaaaaatagtttaattgagtgaagatgttcattgaatggctgcattttttccttttaattttaatatattcttctatggatcacacacattcgaaattttaaaaatacttattctgtggtcaatttgtcttctgttgtgatttttacatatttagagtggtactgcttttattattataatccagttttacaaatgtggaaaaatgtttaaattgtaggacaatattttaaattttaattctaactttttatctttattgttgaatctaatgcctaatggtattaataagagtactaagtaaataatttcagtaaattgaagatgatataaccttcttcatccaagtattataagaaggaaattggttagatgtatgtgtgttataaccatatttgtttagaagtcaattactttgtttttttaaaaaagtttacttcatcccatgatataacatgaaagagatctttgtgaataaattcaaaaatcaaaataaatctctgtgactgttataaaactttgggtaatatctttttgaaatttgtaactataaaacaaaattattttacacatgcagaatagtttgctctttcctctaaaagtccttcttatcttctaactccattaagctaattttaccatgccaatcaaacctagttgttgtttgtctaggaatgtaagatacttctgggagacaatatattcactgttttaattagtggcagtagacctaatccaattatttgaagaaaaaaaaaattatttcttttggagggaagtggcttgccctgacataaatcactagttattgaaggcaaaattccgtaatgttgagaattatttaaaaataaaactgagacgttatattta

SEQ ID NO: 121007 - DNA, 2103 bp, Homo sapiens
  Payload ID: 3719
  Gene Symbol: CCDC34
  Gene Name: coiled-coil domain containing 34
  Uniprot ID: Q96HJ3
  ENST ID: ENST00000328697
  CDS Start-End: 675-1796
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctggccgggattggccggcctggcgcgcgcagggcccgctgggaaagcgcgtccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaactttttaaggttgatcttggcatgttgttttgcagaataagtggctgaatatgtaagaattgtgtttgtatttagcttgtattaaaagtacactgtaataccaataaaactaacaatttttcttg

SEQ ID NO: 121008 - DNA, 2613 bp, Homo sapiens
  Payload ID: 3720
  Gene Symbol: CCDC36
  Gene Name: coiled-coil domain containing 36
  Uniprot ID: Q8IYA8
  ENST ID: ENST00000296449
  CDS Start-End: 388-2172
gcttttccttcatctccaaagtcctctaaactgacagggtctcattctgtcgcccaggctggagtgtagtgacgcgatctcggctcactgcaacctctacctcccaggttcaaacgatcctcccgcctcagcctccgagtagctgggaccacaggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccagggcctccttgttctggtcatacacagtggagtgtaggtcgagcgacaagtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcagga

SEQ ID NO: 121009 - DNA, 2843 bp, Homo sapiens
  Payload ID: 3720
  Gene Symbol: CCDC36
  Gene Name: coiled-coil domain containing 36
  Uniprot ID: Q8IYA8
  ENST ID: ENST00000438782
  CDS Start-End: 237-2021
caggggcccggttcgatgtccccatctgcccacggcgcctctcgtgccagctgctccgcctgtcctgcccttgctcagaccacccaagtatcatctgtgctctggcccctggccaccagttccaccccacatgctgtcctcacaggtggcgccttgccattcctggggaccagggcctccttgttctggtcatacacagtggagtgtaggtcgagcgacaagtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcaggatttttttctttcttatttttagccacttatgctaccagaatgtttgcattttttgatcagtagacatattacaggacaccctaaatcttcttgtgaacagagaaaataaaatgataagcctgccagtgaaagaggtgacattcactagcaaatgtccagagcatatcactgctcacaagccatttttcttcctggttgctttttcccttgtcctgtttttcaagcactttcttaaaactaataatattgtagaccttgtatttctgaagagcagtgggcttatatgggactttggctttccatttttatcttgctgaagtttttgagtttttgcaacacaagtattttttgttatcagaaataagataaaacatttaaaag

SEQ ID NO: 121010 - DNA, 1568 bp, Homo sapiens
  Payload ID: 3720
  Gene Symbol: CCDC36
  Gene Name: coiled-coil domain containing 36
  Uniprot ID: Q8IYA8
  ENST ID: ENST00000366429
  CDS Start-End: 80-691
ggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagttgcagacgtctgtggaaaagtctgaggaccatctcagttcaagaagccaatctattttggattctttggagactgtggccaagacatgtgagtgcctcatgtttgaggtatcagcagagggcactggtgaatgatgaacatgaactttctgaccccagcctggtttccagtggtgaggttcctcacagggtttcagatgagaggatgggtatatagggttagtcctgaagagatgtggagcacactgagctgggtagtgaggcccacctctatgtgacaatgctctggtcccatgatgccttttgtgaggcactaatcccccacctggtaaccatgttgcctcagggcaggtagctctgctaggtttctcatctcactgcctgaagtgagtcagcaacatccttgagtctcaaattgctgcctgtgctgtctatagacactgactgcccccttaggagttagaaatactgtagtacctgctgctcttcttgctgccttggtttcagtgagagctgtgttgtgaatcacagcatcattctcaattttttttttttttttgagacagagtctcgctctgtcacccaggctggagtgcagtggcgcaatctcggctcactgcaagctccgcctcccgggttcacgccattctcctgcctcagcctcctaagtagctgggactacaggcgtctgccaccacggctggctaatttttaaaatttttagtagagacggggtttcactgtgttagccaggatggtctccatctcctgacctcgtgatctgcccgcctcagcctcccaaagtgctgggattacaggcatgagccaccacgcccagccccattctcaattttacttatagtttgtggtttataaaatcctgtgctccaccaattagtggtttacatttagatgaaaccatggcccttgccctataaacagaagagagtaaatatacagttctccttgggtgaatacttctctagaaccacctgtttcctagcaaaacgatgagctgatgactatgcatctgtacttgtttgcatttgtctgtgtgtttattttataaacaagttgaaatcaacttacacaaa

SEQ ID NO: 121011 - DNA, 2315 bp, Homo sapiens
  Payload ID: 3720
  Gene Symbol: CCDC36
  Gene Name: coiled-coil domain containing 36
  Uniprot ID: Q8IYA8
  ENST ID: ENST00000452691
  CDS Start-End: 90-1874
agaggcagcgggacgcggccacctcgaagccacgtcagggcagccccaggtcgggcgcgtgccagcagccagaggtataactataagaaatgaattttaatgtctggaatatcaaagagatgctcagtattccttcaggctctgggaacaagaagtcatccaactggaataataatcaaaatgattattccagtctcagtgattcccagttcctctttggatctcagttctgtccagaaaattcagaaaccctatcagcacccttggactttggtgcccacttgagacattcaaaacagtcacaacagaactatctggagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacagtgagactctatacaactttgtttctaatgttagagaaagcattctcaggttgcagacgtctgtggaaaagtctgaggaccatctcagttcaagaagccaatctattttggattctttggagactgtggccaagacattacaagagactatacaggcccagaatgacctggtgtttgaggcagtccaggacaaaggcaacatggagcaggccatccttgagatgaagaaaagatttgaagctagacaaggagagtttatagaaatgaagtccaacctgaagcaccttgaagttttagttgctcagcagagtcaggaattccagcagctgtgtgagcagctaggccagctgaatgtgcccagtgtcctagcagagctgaagagattgatctcagtgcctccagtgaaagacagtgcttctcagacgtcgccacctttggcccagagcctcaatctcaccaggcaggaaaaatacacctctgagaaaccagttttatggcaggcccaggccctccctgctgcatggaatcctggtatgggctccctacagcctggagaatttgatgtctggggtgaaggagcaaagaatgatgatctccaagaagaggctgcactgccagcatttgggtcccatgaaagaaataggcatgtaaaggacaaggtggtgcagactaactgcaagaactgggctgttactaaaacaggtgccaagaaccatggttccagcgtcccaggccataagattcccagtgacagggacctggtttcccaaggagcctcacagctcacatcattggagataaacttttcaaccagcattaagaatgcctgccaaaaatatcaagcccaaagtatgtttttgtgtgacccacgtgaacatttggtgattaaacagaaagatgggactgtagaaatgcgggggaaagacaagaagcagcagcccaggaaggcccacagggcccacagaggcaggctcatagccagcaagcaaaaacaaatcccaatccagacctgtaaattcaattccaaatatcagagtcctcagcctgcaatttctgtccctcaaagccccttcctggggcagcaggaaccccgtgctcagcctctgcatctgcagtgtcccaggagccccagaaaaccagtctgccctattctgggaggaacagtcatgcccaataagacagtaagggcagtgcagggaagactcttgcagctcagcaggtgctcttcccaagacaactggctactttccagcagttcccagggggaccaccagatgagctggttcagtgacctcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactccaaacaacatttttgggtctttaaaatattccctacacatgaccaatacattttcaggcctcagga

SEQ ID NO: 121012 - DNA, 2277 bp, Homo sapiens
  Payload ID: 3721
  Gene Symbol: CCDC38
  Gene Name: coiled-coil domain containing 38
  Uniprot ID: Q502W7
  ENST ID: ENST00000344280
  CDS Start-End: 559-2250
agagccccggaaggggggccatgggggaaacctctgcccggggggttggggtgggagcctggagatagcgctcctggagagggcagagtaggggaaagctgtgcccaggggcagggacgggagcttggaggtagagccccgggagaggacagagtgggggaaacctctgcctagggtgctgggacgcgagcctggaggcagagccccgggagggtactgcgtggaggaaacatctgcccacaggttctggggcgggagcccgggacgcggagggccgcgagccgagggaacctgggggtggggaggagggggatgcggtaggggaggtgctcctgggtccgcgcgggtggcgggtgccccgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggtaaagtaaaagatggctcaaccaaagaggacaggccttataagatctttttcagagatctctttcttgtcaaagaaaatgaaatggcagcaaaggaaacggaaaaatttatgaaccgtaacatgaaagtctaccagaaaactactttttcatccagaatgaagagtcattcatacctgagccaactagctttctaccctaaaaggagtggtaggtcatttgaaaagtttgggccaggtcctgctccgattcctagattaatagaaggttccgacacaaaaaggactgtccatgaatttattaatgaccagagagacaggtttctgctcgagtatgctttgtcaaccaaaagaaacacaatcaaaaagtttgaaaaagacatagcaatgagggaacggcaactaaaaaaagcagagaaaaagctccaagatgatgcactggcctttgaagagttccttcgagaaaatgaccagagatctgtagacgctctgaaaatggcagcacaggaaacaataaacaaactccaaatgacagcagagctgaagaaagcaagcatggaggtacaagcagtgaaaagtgaaatagcaaaaacagaattcctcctcagggagtatatgaaatatggtttttttctgctgcaaatgtctccaaaacattggcaaatccagcaagcactaaaaagagcacaggcatcaaaaagtaaagcaaatatcatccttccaaaaatattagcaaaattatcattacattcaagtaacaaggaaggcatccttgaggagtccgggaggacagctgtcctttcagaagatgcttctcagggaagagacagccaaggaaagccaagcagaagcctgactcgcactccagagaaaaagaaatcaaacctggctgaaagtttcggttcagaagacagtttggaattccttttagatgatgaaatggacgttgatttggagccagcactttatttcaaggaaccagaggagttacttcaagtcctcagagagctggaagagcagaatcttactttgtttcaatattcccaagatgtagatgaaaatcttgaagaggtaaacaaaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattacc

SEQ ID NO: 121013 - DNA, 499 bp, Homo sapiens
  Payload ID: 3721
  Gene Symbol: CCDC38
  Gene Name: coiled-coil domain containing 38
  ENST ID: ENST00000549876
  CDS Start-End: 1-272
aaagagaaaaagttatacaggataaaacaaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattacca

SEQ ID NO: 121014 - DNA, 511 bp, Homo sapiens
  Payload ID: 3721
  Gene Symbol: CCDC38
  Gene Name: coiled-coil domain containing 38
  ENST ID: ENST00000546803
  CDS Start-End: 193-336
atccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggagcagtaagagctatgtcggtgctgtgggaaacagacagaggagctgtgacttctacccaggagatgtggaggcaaggctatctgcattctactgttaaagcaaactaaacatggcctgagaaggactccatactccatacttctatatttgagtccttgtgaacgaactgcaacctaacttaataggtaaagtaaaagatggctcaaccaaagaggacaggccttataagatctttttcagagatctctttcttgtcaaagaaaatgaaatggcagcaaagga

SEQ ID NO: 121015 - DNA, 2599 bp, Homo sapiens
  Payload ID: 3721
  Gene Symbol: CCDC38
  Gene Name: coiled-coil domain containing 38
  ENST ID: ENST00000546386
  CDS Start-End: 220-261
cgcgcgggtggcgggtgccccgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggttaagtctggatacaagcattccatatggaggttcacatcaggggcccaactccttctggcctgttcctgggctatgttcttggtccaagacggctgcttccacaccagtgattacatccatattcctgccagccaggagaaaaggggaaggggggacatgccctgaagttgcattcaccacttccgctgacctgcctccaagggaggctgagaaacatagcctctactctgagtgttcatttagggttctattcctatagaagaaggaagaatggatattgggggttcactagtagtatctgctccactaccattttttttaaaaaagcatttaaaaggagccatgtttggaatttattctacagatatgtatgcacaagtgattaaagatgtgtgtacaggaatatttattgcagcattgtttacaatagcaaaagactggaatcaatcataatgtccattggaaagggttggttatgtaaactataatacaaccagggaatgggataatgggatactagacagacagcttctctgtcacccaagctgaagtgcagtggcaccatctcggctcactgcaacctccgcctcctgggggttcaagcaattctcgtgcctcagccttccgggtagctggaattacaggtgcccaccacgcctggctaatttttgtatttttagtagagacgggttttccccatgctggccaggctagtctccaactcctgacctcaggtgatccgcccgcctcggtctcccaaagtgctgggactacaggtgtgagccaccacacccagcctagttatttagttttttttttttttttgatgtcgtgaatatatatttgctgatataaaaggaactcctaggtatattgctaaccaaaaaaaacaaaatgcagaatattagactagtatggattggatgatgccttttttaattaaaggatttatattactttgtcaagaactgtgacagggctaagattttcctctacttgcaaactcataagttagcttgctacagtttcctggatgttgacaagagatacaaaactcttgggtcagagacaaacgactttattactcacaaaacaacaagcagcatgagttttgacatatttggtaccagttccctaagacccatagccttcttttaagattaatacaattatatattaataacataatatgaacctttgaacccatcagaacccaaagacgaggatcttcacaagaaattacaacctgacaataactacataccctatcccttggctttcaacacctaagccaggcaccatgttgaagtctgtttagaatttttcttcactattttatttgtatgtatagttttatactgtatatatgcagtcttaaagagcatatttttcattttagttttaacttttaaaaaagtatatcttgttgactatcatattttagaaatttttcagttaacattatatatatacatacatatatatttattttaatcttttaaaaacaattgtttttatagacaaggtcttgccatgttgcccaggctggtcttgaattctcgggttcaagcgatccacttcagtgtcccaaactattgggattacaggagtgagccaccatgcccagccaacattatattttaagattcattcatactgttgtatggtttagatcattcattttcactgctgtataatatcacaaaatgcaaatgtaccatagtttacagttgacacttctttgggtatttgggttgttttcagcttattgctactaaatggtgctgctaataaacattcttgttcacatctcctggtatacaagaaagtttctttgcatgtatacctaggaatagaattgctgaatctgacgttagctgagtattcaacttcagataataatgtcaaagtgttttccaaagtagttgtgccaatcataactctacaagaaatgtattagagatcctgtggaattatatcctctccaaacacttggcattgtcaagttttttaatgctttgccaatcaaatgggtgaaattatggtctttatttgcatttccctgataactaatgaagttgaacaactcttcatatgtttattgaccataaatgtttcttcttctgttaaatgcttatttaatacagtcttttttctatttttctttaggttgttagtgctctttatattgatttgcagttttgtagatgtggtatatcccaattatgtcatctctatggagtacaaatattttctcccagttttaatttatctttcaatttgtttatggcgtcttttgatgaacaaagtctttaatcttaatatagctgaatttatcaa

SEQ ID NO: 121016 - DNA, 559 bp, Homo sapiens
  Payload ID: 3721
  Gene Symbol: CCDC38
  Gene Name: coiled-coil domain containing 38
  ENST ID: ENST00000546947
  CDS Start-End: 374-559
ccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggagcagtaagagctatgtcggtgctgtgggaaacagacagaggagctgtgacttctacccaggagatgtggaggtaaagtaaaagatggctcaaccaaagaggacaggccttataagatctttttcagagatctctttcttgtcaaagaaaatgaaatggcagcaaaggaaacggaaaaatttatgaaccgtaacatgaaagtctaccagaaaactactttttcatccagaatgaagagtcattcatacctgagccaactagctttctaccctaaaaggagtggtaggtcatttgaaaagtttgggccaggtcctgctccgattcctagattaatagaaggt

SEQ ID NO: 121017 - DNA, 3279 bp, Homo sapiens
  Payload ID: 3722
  Gene Symbol: CCDC39
  Gene Name: coiled-coil domain containing 39
  Uniprot ID: Q9UFE4
  ENST ID: ENST00000442201
  CDS Start-End: 121-2946
agggctcccccggcaattgccgcggcactgtgcaggtgcctgggcttgacgcgggtgctgctcacccgctgtacaagaaggcggatctttgctctgtatcttctctatccgtttgcagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggctgctcaagaaaaagaagaacttcaaagggaaggtgactgtttggatgccaagatcaacaaagctgaaaaagaaatctacgctctagaaaatacccttcaagtgctgaacagctgtaacaacaattataagcaatcttttaaaaaagtgactccatctagtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttc

SEQ ID NO: 121018 - DNA, 4451 bp, Homo sapiens
  Payload ID: 3722
  Gene Symbol: CCDC39
  Gene Name: coiled-coil domain containing 39
  ENST ID: ENST00000476379
  CDS Start-End: 873-2888
tctttatacttttgtattgtttaattttttttaacagttgtcttgttttttcttctgcagtgaaaataatggtgacaagaagcccactgcctgattcacataagcaaggcatgctgcagggaagacagggttcttattaatatttcctttcatgtgcttacatatgagttacagttgctaatcctttcccacagtttagcacctagttaaaagaaagggcttcggaatcaggtaagtgtagattaaagttataacggcaaattgctgaacctttggaagcctcggtttttccacctggaaaatggatttttatcttacaggactgtcgtgaggattgatgagctaacattcctaaatcagggagtttgaagtctggcccagggtattttcctcctttcctgaaataatgtgtagttctgaccaagtgagaagaatcataagaatatgggattttgaaaaacatgaaaacatcctaagaaataccaggaaggagtcccacagtgaagcacaaatgaaactcaagatgactgcctaaaataagaaatcatggatcttaggagaaagggggcaaggaagtaaatcaaaggacaaagctgaagaccaagtggaccgaaaagaagatggaatacattttcccaaacactggtgttctctggagttggcttatcaacatcttgtgcaatcggaggatcgtgtggtttacttccagccagctgccccgtggtcctccagccagctccgggggccacagttttcacacgctccgggagcgatccgagagccgccttttcgtggaaagttacgctgccgcctggcaacccccgggaacgtcgggaggggcaagttgctgctcatccctcagtgctcaagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattca

SEQ ID NO: 121019 - DNA, 487 bp, Homo sapiens
  Payload ID: 3722
  Gene Symbol: CCDC39
  Gene Name: coiled-coil domain containing 39
  ENST ID: ENST00000473854
  CDS Start-End: 1-308
aagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactaaaataggaaaaaggcatagcaaagtcaagaataaggtgggcgaaaaaaaagaagttgcaggtgcatctgatttccaggaaagtgcaaaaagcagatccgcttttttggagatgaatttctgtatctcgatgttgtcaactctcttctcttttcttaaaaagaaaaaaatatatatgaaaattggg

SEQ ID NO: 121020 - DNA, 783 bp, Homo sapiens
  Payload ID: 3722
  Gene Symbol: CCDC39
  Gene Name: coiled-coil domain containing 39
  ENST ID: ENST00000471307
  CDS Start-End: 492-783
ctagtttttgcctccactaccttactgatcatgcatttgcaagattaagtatttccaatatttattattataaaccacatattatatctttgttactatcgctgtagtatatgacctggaacggctagactaagagtatcactccatcacccaggctggagcacagtggtgcaacctcagctcactgcaagctctgcctcctgggttcgagtgattcatgtgcctcagcctcccaagaagctggaattacagagtaatcaaaaagaggagccgactagacacagccaggaagagcttctcccaccggaagaccagaccagcaagaaagttggcaccctccaagcaggttgttgaaaggaaggccttgaatgtggacagaggacgatgcagatgaggaaagactagaaggttctgtacctgttaacagtggctgatcctagaagagtgaaatttagggtagttggaaagaacacagcacagaaaactttaggatgaattttcctagcagccattctgtatcgtcaaagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaa

SEQ ID NO: 121021 - DNA, 534 bp, Homo sapiens
  Payload ID: 3722
  Gene Symbol: CCDC39
  Gene Name: coiled-coil domain containing 39
  ENST ID: ENST00000489868
  CDS Start-End: 1-204
cgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaagaaataggaaaaaggcatagcaaagtcaagaataaggtgggcgaaaaaaaaggatgccctagatgaatgccttctggaactgcgagaagactctgaacggttcctcttatgtttcttatgccttttgtgaccagaagaggaagaggatgatgatgaagacactgattcatcagcagaagaaacacttgaagaagaagttgattttcttcttttcttctttagcctaaaaaaaacagttcatttgtcatatatatacaaaaatgtttctaaattattcataaagatgtgggccctatttgtttcctttaaagattttataaaagctgtggttcagataaatgatacaataa

SEQ ID NO: 121022 - DNA, 1970 bp, Homo sapiens
  Payload ID: 3723
  Gene Symbol: CCDC40
  Gene Name: coiled-coil domain containing 40
  Uniprot ID: Q4G0X9
  ENST ID: ENST00000269318
  CDS Start-End: 12-1751
agcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagcgtgtccctagagcgcttcccaagtcaaaatataaacaccgctcgttcccgcctttctaccacatggcattccgctgggatacttctacggggaagcttcctgcccggggcatcgagggcgttcgcgtccgtctgttatggcggtgctgctgtagataaccggatccgcgaatgctaacgctcaccaggatgctatatagccttttttatattgcctatcaagcccggaatgtctgggtctagcgggtattgctaagtaggattgtgacagtcacgcccccggcagcggtgtttcaaagtcccctgacagctcagcatgttgtcacacttcaggactgtgccaatccgattgatgaagaaaatagataatcttgttttataaaacgtgcatgcgcag

SEQ ID NO: 121023 - DNA, 2010 bp, Homo sapiens
  Payload ID: 3723
  Gene Symbol: CCDC40
  Gene Name: coiled-coil domain containing 40
  Uniprot ID: Q4G0X9
  ENST ID: ENST00000374876
  CDS Start-End: 6-1442
gggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcagggcgttggagacacaggtgctgccttcattcctaaaaccacccagggtgaccaggtctcgggacgcggaaagaaaaagccgggcactgtggtggcacgtgtctcacccgctgagctttaacttcccctccacctttcgtagtctccaccccttgtgcccagcacagagcctggcatacagcaagcgctcaagaaaggctggaccaaggaatgagggtctggctggccccacagcacccgcagccaggcagccagcagcagtcacacaaccaggagatgcttttccttttgggtgctgtgattaaagaaacaaaatgaaaccattttgtttttaaaagtttttagaccaaaacattttcaaatgaataatattggattaaccatactcatttctggccaggcgcagtggctcgcacctgtaatcccaacattttgggaggctgagacgggtgggtcacgaggccaggagttcaagaccagcctggccaagatggtgaaaccccgtctctactaaaaatacaaaaattagccaggcatggtgtgggcgcctgtaatccccgctactcgggagggtgagacagagaactgcttgaattgcggaggttgtagtgagccgagatcacgccactgcactctagcctgggagacagagcaagactctgtctcaaaaaaaataaaaataataataa

SEQ ID NO: 121024 - DNA, 3544 bp, Homo sapiens
  Payload ID: 3723
  Gene Symbol: CCDC40
  Gene Name: coiled-coil domain containing 40
  Uniprot ID: Q4G0X9
  ENST ID: ENST00000374877
  CDS Start-End: 32-3124
ggatgttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaagaaatattgcagaacaacacaggacgcacacaggcacgtgcacgaacaacacgggacgcacgcaggcacgtgcacgaagaacacgggacgcgcgcaggcacgtgcacgaacaacacgggacgcgcgcgggcacgtgcacgaacaacacgggacgcgcgcaggcacgtgcacgaacaacacgggacgcgcgcaggcacgtgcacgaacaagggacgcgcgcaggcacgtgcacgaacacaggacacacacagcacgtgcatgaacaacacaggacacacacagcacgtgcatgaacaacacaggacacacacaagcacgtgcatgaacaacacaggacacacacaagcacgtgcatgtcatctcacaaaacgctgttttattcctactccatgtaatcacagcacgctggtatttttaaatgccggttgtaaccctcaaactttgtgaccctctaacgtatcccactgtgagacagtctcacaccacagaagggctcagagagcacccccatctcatccttcacagccgcgttgtctctccatggtcacaattagatttcattgcctttaaaaggctggtaattaaattgcaagtggtcatcaagctaaaggttcagggccttaaggataacagtaagagcagttcataaaataaatgggcctcactttcaccatgccatgct

SEQ ID NO: 121025 - DNA, 4294 bp, Homo sapiens
  Payload ID: 3723
  Gene Symbol: CCDC40
  Gene Name: coiled-coil domain containing 40
  Uniprot ID: Q4G0X9
  ENST ID: ENST00000397545
  CDS Start-End: 28-3456
gttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaaggtcaggctcgggcagctgctgaagcagcaggagaagatgatccgtgccatggagttggcggttgcccgcagagagaccgtcaccacccaggccgaggggcagcgcaagatggacaggaaggcgctcacccgcaccgacttccaccacaagcagcttgagctgcgccggaaaatcagggacgttcgcaaggccaccgatgagtgcaccaaaaccgtcctggaactggaagaaacacaaagaaatgtgagcagctccctcctagagaagcaggaaaagctgtcggtgattcaggcagacttcgacacactcgaggccgacctcacccggcttggggccctcaaacgacagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggactccgccttgcaaggcctccaggaagagatccggaattgtgtttgtcatgagggacttggaatcttttgtgttcctaaaaaccacatgtaccctcagaagggcatcgtttaagagaaataagccagccccacccataggaatctttttagccactcagcaatttaataaaccaggtaaaatcctagcgtttcccatggcatcccatcgcaaagacagagcctgtgactgcagacccacacacccacactcccacactgggcttactcgtccaggtaacactttggtttgcagcactcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccccaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttttctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatctagtaa

SEQ ID NO: 121026 - DNA, 466 bp, Homo sapiens
  Payload ID: 3723
  Gene Symbol: CCDC40
  Gene Name: coiled-coil domain containing 40
  ENST ID: ENST00000576033
  CDS Start-End: 170-466
aaatggcggaaccgggcggcgcggcgggccggcatgatatagtgctatggttcctgacaaacaggacaaagacgtgacaacagcctgggggtggcagagaagtaacaagtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatac

SEQ ID NO: 121027 - DNA, 537 bp, Homo sapiens
  Payload ID: 3723
  Gene Symbol: CCDC40
  Gene Name: coiled-coil domain containing 40
  ENST ID: ENST00000574099
  CDS Start-End: 159-537
aaatggcggaaccgggcggcgcggcgggccggtaagccgggccgaggggcagcgggtcttggagtcgccaggccgcgctctccgttcaccgctccaggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtca

SEQ ID NO: 121028 - DNA, 554 bp, Homo sapiens
  Payload ID: 3723
  Gene Symbol: CCDC40
  Gene Name: coiled-coil domain containing 40
  ENST ID: ENST00000573474
  CDS Start-End: 1-257
actatacagaaacttcatccccggaagggcaaatcagtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgca

SEQ ID NO: 121029 - DNA, 593 bp, Homo sapiens
  Payload ID: 3723
  Gene Symbol: CCDC40
  Gene Name: coiled-coil domain containing 40
  ENST ID: ENST00000571028
  CDS Start-End: 1-251
ctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagatgcaggtcgaggaaccagagccagctgtggccgggcaagggctcctctccctgtgtcaccagggttgcctgaacaccaggacgagaggacttggccatctgcccacttgggtgtctttttcctcctgccccaatgctaggacttgatacctgactgtttaattacacggctcagctgccacgggccttaagaaaagtcaaggccaggttctctctgagggtccagcacctggcctggctctccgaggctcatggcctgtgaaccctgcagcgtccccaagggaagacgtcacctccgagatggtcctgttgtccagctctcccctgcatcccagactaaccagtgtcctctctgcaaaccgtcctcattgccctcagagacatggcttccttttggttgcaaacattgtaaaaa

SEQ ID NO: 121030 - DNA, 1374 bp, Homo sapiens
  Payload ID: 3724
  Gene Symbol: CCDC42
  Gene Name: coiled-coil domain containing 42
  Uniprot ID: Q96M95
  ENST ID: ENST00000293845
  CDS Start-End: 228-1178
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccccatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgagttcgaggagatccatgaggtgattgcacgctacaagacgctggtgagcatgcgccacgacctcatgcagtctgcgcaggaaggccaggagaagattgagcgcgccaaggcccggctggcgcgctacatggaggaaaaggatgatgagatcctgcagcaaaacaatgagctggcaaggctgcagatgcgctttgaccgtgcccgcagcaatgtcatcttctgggaatctcgctgggcgcacatccagaacaccgcagccaagaagaccctcctgcttggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttc

SEQ ID NO: 121031 - DNA, 1087 bp, Homo sapiens
  Payload ID: 3724
  Gene Symbol: CCDC42
  Gene Name: coiled-coil domain containing 42
  Uniprot ID: Q96M95
  ENST ID: ENST00000539522
  CDS Start-End: 179-907
gccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccccatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgaggaatctcgctgggcgcacatccagaacaccgcagccaagaagaccctcctgcttggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaa

SEQ ID NO: 121032 - DNA, 538 bp, Homo sapiens
  Payload ID: 3724
  Gene Symbol: CCDC42
  Gene Name: coiled-coil domain containing 42
  ENST ID: ENST00000581598
  CDS Start-End: 503-538
aacctcgcgcctcctcgcgactccacccctgccgccgctaagcacctcctttctttctctgctcttcttcaccaaggcccggcccctccctcaccctcacccacacctgaaccccagggaggccctaagagcagggcgcccgcacaaggccgctcctccacccgatgccccttctcagccacactcaccagaaactgcctctggccctgggctccatggcaaccagcatctaaccaggcctaatgccttcccagaagttcctgagggcaaagggcaggagcagagagcaggaccccagcaaggggaggaccaatgggggcagggggcagggggcagagggcagcgcctggactccacgtgccggccacagaaccaggcagcctgttgctaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggcc

SEQ ID NO: 121033 - DNA, 2082 bp, Homo sapiens
  Payload ID: 3725
  Gene Symbol: CCDC43
  Gene Name: coiled-coil domain containing 43
  Uniprot ID: Q96MW1
  ENST ID: ENST00000315286
  CDS Start-End: 10-684
gaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaat

SEQ ID NO: 121034 - DNA, 2058 bp, Homo sapiens
  Payload ID: 3725
  Gene Symbol: CCDC43
  Gene Name: coiled-coil domain containing 43
  Uniprot ID: Q96MW1
  ENST ID: ENST00000457422
  CDS Start-End: 27-491
ggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggattctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 121035 - DNA, 2067 bp, Homo sapiens
  Payload ID: 3725
  Gene Symbol: CCDC43
  Gene Name: coiled-coil domain containing 43
  ENST ID: ENST00000588210
  CDS Start-End: 11-694
tgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggaatcacttactgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaa

SEQ ID NO: 121036 - DNA, 721 bp, Homo sapiens
  Payload ID: 3725
  Gene Symbol: CCDC43
  Gene Name: coiled-coil domain containing 43
  ENST ID: ENST00000588687
  CDS Start-End: 1-332
tagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaaggaactccttgcctttgccgattggaagcattaacaatttcatcctttctacgtgactgtacaatgtgaatagactccaagtgtctatcaagagcagtagagatactggcatgaagaagagaactccgaagacgttccattttgcctagtaaagtcacaacctgagggaagcattttaaattttgataagacatgtcctgccattaacttaagtaaaaacaaatcttcagtgaagcagaatagagatgacagcaataatattcattcaataaatcaaagaatgcttactgtgtcctgacaccatgctgggggaaacaaaaatggaaagtgttttctatctacttgtctatgttaattctaaaaatatgtggtagttgattactgaaaataagcatcaatgaaaatgttaaatattcaaacattaccatgtcattaactgcaaatacaagatctgatac

SEQ ID NO: 121037 - DNA, 3466 bp, Homo sapiens
  Payload ID: 3726
  Gene Symbol: CCDC47
  Gene Name: coiled-coil domain containing 47
  Uniprot ID: Q96A33
  ENST ID: ENST00000225726
  CDS Start-End: 384-1835
gtaggaggattgggataggcgagggcagttccggcccaggggcggggattatgtaattttcccaaaagccccacctcgcctcagccgggcgggagagagggaggtctcgcgctttccccggggttgcgtcccgccccgcaggctgcgcgcaggcgctgacgagccgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctca

SEQ ID NO: 121038 - DNA, 2195 bp, Homo sapiens
  Payload ID: 3726
  Gene Symbol: CCDC47
  Gene Name: coiled-coil domain containing 47
  Uniprot ID: Q96A33
  ENST ID: ENST00000403162
  CDS Start-End: 266-1717
agaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacaggagtcatagaggctgggtggtctggcaaggacttgtgcatttgagaactgacaggtgcagcggagacttctaagagggaaaaccaagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgtttt

SEQ ID NO: 121039 - DNA, 552 bp, Homo sapiens
  Payload ID: 3726
  Gene Symbol: CCDC47
  Gene Name: coiled-coil domain containing 47
  ENST ID: ENST00000580986
  CDS Start-End: 496-552
gaaagctgggtagagacgtgcagacgaagacattccagggagaaagactgaactagcaaaggctaggaagtgagaataaatgtggaacacacttataaaggaagacaatttagctagtttgtgttttcggcaatggcggaaaataagatatgatctaaatgactttaaatatagtggactaaaaacaactgattatataagccacattactttatcacttgtatttttggaggtggaaggaagagttctagtgacagtgattagcatctactctacatatactttgagagtacctcacacactatatacagcttttgcctctcaggaccccaaattcggaggcctgcatctcccaagcgctgcctccttgggtcagaattctccccgcgctattcctgccctggagccgggcaccctgcaaatccttttcctaggcgagggggcgccgcctccggaaagccgccaactgggcctcgctttttttctcaaggtgcaatgaaagccttccacactttctgtgttgtccttctggtgtttgggagtgtctctgaa

SEQ ID NO: 121040 - DNA, 1719 bp, Homo sapiens
  Payload ID: 3726
  Gene Symbol: CCDC47
  Gene Name: coiled-coil domain containing 47
  Uniprot ID: Q96A33
  ENST ID: ENST00000582252
  CDS Start-End: 179-1621
agaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggttagacaaacttatcactggggtaaaactacgatttgtaaggatgactgcttgtgttctgttggttgttaaggtaatctttgtaggctaaaagtttagcattttctcaacatttgggacattgtatcaattgataacactataaagaagaataaataatccttcctgtt

SEQ ID NO: 121041 - DNA, 1586 bp, Homo sapiens
  Payload ID: 3726
  Gene Symbol: CCDC47
  Gene Name: coiled-coil domain containing 47
  ENST ID: ENST00000612558
  CDS Start-End: 560-1132
gacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggaggtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgc

SEQ ID NO: 121042 - DNA, 8429 bp, Homo sapiens
  Payload ID: 3727
  Gene Symbol: CCDC50
  Gene Name: coiled-coil domain containing 50
  Uniprot ID: Q8IVM0
  ENST ID: ENST00000392455
  CDS Start-End: 599-1519
cgctcacgggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgttttttgagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattcaacatctttattgaaaatttgttactttttttaaaggtttttaaaagattacaattttaaaatattttatgtttattttatttttgtgtaaagcaaacacttttaaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccagcagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagattttttatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctgtttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattgaaatcctcaataaatactgccaagtgtggatcagttgga

SEQ ID NO: 121043 - DNA, 2454 bp, Homo sapiens
  Payload ID: 3727
  Gene Symbol: CCDC50
  Gene Name: coiled-coil domain containing 50
  Uniprot ID: Q8IVM0
  ENST ID: ENST00000392456
  CDS Start-End: 591-2039
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagaccaaccagggtcaaggagggccagggaattgggttctggattctcaagaccttgtagactccaaagagatggaaagactgtgaagcacaagaaagagaaaccagaacatccactggagaacttggaagagccagaacaacattgttcatcgaagagatccctgtcatcctctagctcgggcaaagggagggacaatccccatattaacaatgagcagcatgaaaggaaacggtccactcaggagaggcctcggagacctctgcttcccacgatcagtggtgaagtgtttctgagcactgaatgtgatgactgggagactaagattaaccatcagactcgaaattgggaaaaacagtctcgacaccaagatcgactttcacccaagtcctcacaaaaagcagggcttcactgcaaggaagttgtatatgggagggaccatgggcaaggtgagcacagaaaaaggagacacaggcccaggactcctccattctcagagagtgaggagcagctccacctccatgacgcaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttg

SEQ ID NO: 121044 - DNA, 1560 bp, Homo sapiens
  Payload ID: 3728
  Gene Symbol: CCDC51
  Gene Name: coiled-coil domain containing 51
  Uniprot ID: Q96ER9
  ENST ID: ENST00000395694
  CDS Start-End: 87-1322
tagaatcggaaccgtaggaggggtacttaaccggacggcctaccaggcctgtggccgtgcgcgggaagagcactgcagatctcaggatgatggggcgcagccctgggtttgccatgcagcacatcgtgggtgtgccccacgtactggttcggaggggcctccttggaagggacctcttcatgaccaggactctctgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacctgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaa

SEQ ID NO: 121045 - DNA, 1554 bp, Homo sapiens
  Payload ID: 3728
  Gene Symbol: CCDC51
  Gene Name: coiled-coil domain containing 51
  Uniprot ID: Q96ER9
  ENST ID: ENST00000442740
  CDS Start-End: 433-1341
gccaggtacgaggagctagggttgtcctgccagggtagaatcggaaccgtaggaggggtacttaaccggacggcctaccaggcctgtggccgtgcgcgggaagagcactgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagagctcacaccccagtgacctcttctgggaatgccttgctgggaatgcagctgagcctgtgtgggtgtggagagaaggtgcagatggcctccggttttctctttgcaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacctgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaata

SEQ ID NO: 121046 - DNA, 1385 bp, Homo sapiens
  Payload ID: 3728
  Gene Symbol: CCDC51
  Gene Name: coiled-coil domain containing 51
  Uniprot ID: Q96ER9
  ENST ID: ENST00000412398
  CDS Start-End: 239-1147
agacgattggtcgggccacgccagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacctgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaa

SEQ ID NO: 121047 - DNA, 556 bp, Homo sapiens
  Payload ID: 3728
  Gene Symbol: CCDC51
  Gene Name: coiled-coil domain containing 51
  ENST ID: ENST00000438370
  CDS Start-End: 370-556
cgtccatctccttggcctgcttcttgggctgtttcagtggcttcttcttgccacctgtgggcgacacgagcacgttcggcctgcccctgccgcccggtccccaccccgccgtccccgcagtcctcacggttccggaacacttaccttcgcggccggacatggcgcctgccgccgcttccccagaccctgccaccggaaacggagcgtctgccccaccctttgtcgtagacagcgaggcggccccgctgattggctcctagtcaggaagttgaactctcgctaccggatgcggcgctccaggggcgggtactaacaggtcagaggtcaactgagtggcagacgattggtcgggccacgccagatctcaggatgatggggcgcagccctgggtttgccatgcagcacatcgtgggtgtgccccacgtactggttcggaggggcctccttggaagggacctcttcatgaccaggactctctgcagcccaggcccaagccagcccggagagaaaagacctgaggaggtggccctggggctgcaccaccgcctcccagcac

SEQ ID NO: 121048 - DNA, 833 bp, Homo sapiens
  Payload ID: 3728
  Gene Symbol: CCDC51
  Gene Name: coiled-coil domain containing 51
  ENST ID: ENST00000446140
  CDS Start-End: 357-833
aatttttttgaccattttcatagatgatttttaaaaccacaggactggataagagaggagtctgagtgccgagtgccggggtgctacagtttccagaggttaggcagatgagtggggactggaaaccgagtgaaaaatggcatgtgaaggaggagcaggtgaaggccagatcagagggagctggacggaatcagagaagaggaacagaaacagtgaattcaggcagtctgtcaaggagtttggttataaaggaaaccaaagaaatggggcagttgctggtgggggggtgtcagatcaattactgagtaatgtctcaggaggagagaggatttgggacctggggcacagatctcaggatgatggggcgcagccctgggtttgccatgcagcacatcgtgggtgtgccccacgtactggttcggaggggcctccttggaagggacctcttcatgaccaggactctctgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcag

SEQ ID NO: 121049 - DNA, 1461 bp, Homo sapiens
  Payload ID: 3728
  Gene Symbol: CCDC51
  Gene Name: coiled-coil domain containing 51
  Uniprot ID: Q96ER9
  ENST ID: ENST00000447018
  CDS Start-End: 309-1217
ggttgtcctgccagggtagaatcggaaccgtaggaggggtacttaaccggacggcctaccaggcctgtggccgtgcgcgggaagagcactgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacctgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaacaatcagac

SEQ ID NO: 121050 - DNA, 916 bp, Homo sapiens
  Payload ID: 3729
  Gene Symbol: CCDC53
  Gene Name: coiled-coil domain containing 53
  Uniprot ID: Q9Y3C0
  ENST ID: ENST00000240079
  CDS Start-End: 163-747
ggaagccgccgagtgattagtgagcggagaagctttcttccggcgggaagggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccagta

SEQ ID NO: 121051 - DNA, 886 bp, Homo sapiens
  Payload ID: 3729
  Gene Symbol: CCDC53
  Gene Name: coiled-coil domain containing 53
  ENST ID: ENST00000538761
  CDS Start-End: 13-165
cccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagtagagttggggtttcaccatgttgaccatcctgacctcagatgatacacctgcctcggcctcccaaagtgctgggattacaggcatgagccattgtgcccagcctatgaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgccagtatgtcttgttgct

SEQ ID NO: 121052 - DNA, 945 bp, Homo sapiens
  Payload ID: 3729
  Gene Symbol: CCDC53
  Gene Name: coiled-coil domain containing 53
  ENST ID: ENST00000544341
  CDS Start-End: 112-633
gccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgaaaaaattaaaaaaagaaaaaaatgaagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 121053 - DNA, 921 bp, Homo sapiens
  Payload ID: 3729
  Gene Symbol: CCDC53
  Gene Name: coiled-coil domain containing 53
  ENST ID: ENST00000535501
  CDS Start-End: 73-258
attaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagacagggtctcactttgtcacccatgctggagtgtagtggagtgaacttagctcactgcagcctagacctcctgcctcagcgccccaagtagctggaactacagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgc

SEQ ID NO: 121054 - DNA, 883 bp, Homo sapiens
  Payload ID: 3729
  Gene Symbol: CCDC53
  Gene Name: coiled-coil domain containing 53
  ENST ID: ENST00000540536
  CDS Start-End: 39-548
tttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgaggtgaagtaagaacatttatgatcataatatgcagagccaaatttctgttccccttgaaaatatgaatatcccgcctggaaatgatggtattgctgaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcc

SEQ ID NO: 121055 - DNA, 865 bp, Homo sapiens
  Payload ID: 3729
  Gene Symbol: CCDC53
  Gene Name: coiled-coil domain containing 53
  ENST ID: ENST00000545679
  CDS Start-End: 118-699
ggaagggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagaacagtacacaagactctggactacaggaaagtgaagtatcagcagaaaatatcttaactgtagccaaggatccaagatatgccagatatctcaaaatggttcaagtgggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctgcca

SEQ ID NO: 121056 - DNA, 477 bp, Homo sapiens
  Payload ID: 3729
  Gene Symbol: CCDC53
  Gene Name: coiled-coil domain containing 53
  ENST ID: ENST00000542923
  CDS Start-End: 1-324
aaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagggtgtaccagtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcag

SEQ ID NO: 121057 - DNA, 588 bp, Homo sapiens
  Payload ID: 3729
  Gene Symbol: CCDC53
  Gene Name: coiled-coil domain containing 53
  ENST ID: ENST00000500685
  CDS Start-End: 51-284
atctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagacggggtcttgctgtatcaccgaggctggagtgcagtggcgtgatcacagctcagggcaacctcaacttcctgggctcaagtgatcctcccacctcagcctccctagaagcttggactatagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagaacagtacacaagactctggactacaggaaagtgaagtatcagcagaaaatatcttaactgtagccaaggatccaagatatgccagatatct

SEQ ID NO: 121058 - DNA, 1444 bp, Homo sapiens
  Payload ID: 3730
  Gene Symbol: CCDC54
  Gene Name: coiled-coil domain containing 54
  Uniprot ID: Q8NEL0
  ENST ID: ENST00000261058
  CDS Start-End: 395-1381
gtagcaacaggtgtttttctgtgttcctcaggctgctcaacaatttctatgattcaaaaagagccctatgaccaaaacttttgagaactgctgtagttaaatatgtttgttctaagccagcagtcattgtgacatcagcagcaggtcaatgattaccatatgaaagattccatgcagttgactattatttcacagagctctctggttgggctgctctataagaagctaatcacctaacagtgtctattgctgtggctgatgatttccagagtgttctaagatgttatcaggaaaggcatccaacaaatagtaagagaaggaccatttcatttgtacattatttcttcctgtgattctgttttccaacaccttgcctcttgtttcaccatgaaagatgtacacacttcacaccaaaagggtaaaagctgctgctaggcagatgtggacttcaaatctctccaaggtcagacagtctcttaaaaatgtttaccacaaatgtaagattcggcaccaagattcaactggatatcccactgtgacatctgatgattgtaatcaagatgatgatagttatgacggaaaaatgaatcttccagtagtgctccaagatgttaaaactgctcaagttgaacttttcagccaaatgactgacattgtccatatgataccaaaagtccaggaaaagactgacttgtatcaaaaacagatggaggtcctggaaaccagaatgaatgttaatgaagacaaacaatgcacaacgactaaagatatcctctctatgaaagaagacatcaaggcattaaagaagaaggtgacagaactggaaattcagaattcctgctccacgatacattgtctagagattctggagggagaaaggggtaaagaaatcacagaactgctttacaaactcatacaaccagcaactctgaagaacactttggcctctacagacatggaaatctcttcagcagaaccagagaaagtgcccagttatccaaagtccactgaccatcttgagaaaaaaacaatttctccccaaatgaaaactctgaagaaacgtaaccatcaaaatgcatcaaggagctttgaaaaagcaaagccaaatatttacatttacccagacttcagtacatggatcaagctaacttttgttcatggaggaaaatggacatttttcctcagtgctaccaagttagaagaattcatccagtggcttctttctaggccaaccattcttcctgaggaaccccaggtcataacccagagatactgtccattcactgggcccattttgagcttgaccacaatctgtctctccatcttcaacaatatttacggctttatttgttccttaaaagaagaagtaactcgactatagagttatgttctgctttgcttggcacaaaataaatgtaacctggaggctccaagtattcacaca

SEQ ID NO: 121059 - DNA, 3000 bp, Homo sapiens
  Payload ID: 3731
  Gene Symbol: CCDC57
  Gene Name: coiled-coil domain containing 57
  Uniprot ID: Q2TAC2
  ENST ID: ENST00000389641
  CDS Start-End: 38-2788
cctggccagcgctgctggcgggcgttaggcggccaccatgctgccactgggctcagagcccgccctgaatgagctgctgcttcgcaaggaggaggagtggagggcgctgcaggcacaccgcacccagctgcaggaggcggctctgcaggacacacggagccagctggaggaggcgcaggggaaactgcggtgcctgcaggaggactttgtctacaaccttcaggtgctggaggagcgggacctcgagctggagcgctatgacgccgccttcgcccaggccagggagtgggaagaggccaggcgggcagaggtgagcgagctcaagatagaggcagctaagctgaggcaggcgctagccagagaggccaggaaggtggaggagctgcagcagcagcagcagctggcattccaggagcatcgcctggagctggagcgcgtccacagtgacaagaatggtgagattgaccaccaccgggaacagtatgaaaatctaaaatggacactggagagaaaacttgaggagctcgacggtgagcttgctctgcagagacaggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggacctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcagctccgcagggcagagtggagacaggctgacaccgccaaggagaaggacgctgccattgaccaacttcgtgaagatgcatcaactgtaaaatctgcctgggatgctcaaattgctcaactatctaaggagatggtctccagagaccttcagattcagacgctgcaggaagaagaggtgaagctcaaggcacaggtggcccgatcccagcaggacattgaaaggtacaagcaacagctgtccctggcagtggaaagggagcggagcctggagcgtgatcaggtgcagctgggcctggactggcagcgccgctgtgatgacattgaaagggaccagatccaaaagtcagaggccctgattcagggtctgagcatggcaaaaagtcaggttgctgccaagctgcaggagacagagcaggcgctacaggagcaggaggtggtgctgaaggccgtgaccctggaacgagaccaggccgtgcaggccctgaggatgcatgggctccccagaccaggggcacagatgcttctcaggcagcatgaagaagaaataagtaaagactttccatccagtgagatccagcggctccgagagcagaacacgagcttgcgaaacgcgattgcccagatgaggaaagaaatggaggctctaagccatcagattcctcctcccatccagacagcggcagagagcacagatgcaaaccagcctgacccagaggctgggggagatgccgccactcctgattatgttctggcccttgaagcagaaatacgaactctaaagcataagtttaaaactctggaaaagcatctagaagatgtgttggatcctttaaagatgtcctcacctcatgctgagtctcagcccagcgtccgcacctcgacagagacgactggagggtctgcccaagctggtcaagccggagggtctgtccaagctggtcaagcaggaggatctgtccaagctggcccagtatcctctggactggcactcaggaagctcggggacagagtgcagctcctaaacctgctggtgacacgactcagacagaaggtgctgcgggaacccctggagccggccgctctccagcgtgagcttccccgtgaggtggaccaggtacacctggaggttttggagctgcggaagcaggtggctgagctggggaagcatctcaggatagcccagcacgggggagcggagccttcaggcaggaagcagcccccagcctcggacgccgtggcccttgggagagagcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacattatggactgacttcctccccccaccccgccccactaaggggtgctcggggcctccgcatggtgcctgtgctttcacctacgtgttgtgggggggtgtgggcacagcgtgcagggtggaggcagggagctgcagggcaggctcccaaatgctgctgaggcgaccctgctgactgaaggcctccctgagcacagggcccattaaaaccaggttcctccctgggg

SEQ ID NO: 121060 - DNA, 2896 bp, Homo sapiens
  Payload ID: 3731
  Gene Symbol: CCDC57
  Gene Name: coiled-coil domain containing 57
  Uniprot ID: Q2TAC2
  ENST ID: ENST00000392343
  CDS Start-End: 356-2611
cctggccagcgctgctggcgggcgttagggtatttctggaaaactcaaactgtttttcctctactctgataccacaagaatcatcagcacagaggaagacttctgtgatcaaatgtggtgggagagggaggttttcaccagcacatgagcagtcagttctgccgcagactcggcgggtgtccttcggttcagttccaacaccgcctgcctggagagaggtcagaccacagggtgagggctcagtccccaagacataaacacccaagacataaacacccaacaggtccaccccgcctgctgcccaggcagagccgattcaccaagacgggaattaggatagagaaagacggccaccatgctgccactgggctcagagcccgccctgaatgagctgctgcttcgcaaggaggaggagtggagggcgctgcaggcacaccgcacccagctgcaggaggcggctctgcaggacacacggagccagctggaggaggcgcaggggaaactgcggtgcctgcaggaggactttgtctacaaccttcaggtgctggaggagcgggacctcgagctggagcgctatgacgccgccttcgcccaggccagggagtgggaagaggccaggcgggcagaggtgagcgagctcaagatagaggcagctaagctgaggcaggcgctagccagagaggccaggaaggtggaggagctgcagcagcagcagcagctggcattccaggagcatcgcctggagctggagcgcgtccacagtgacaagaatggtgagattgaccaccaccgggaacagtatgaaaatctaaaatggacactggagagaaaacttgaggagctcgacggtgagcttgctctgcagagacaggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggacctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtggagcagctgcaggagctgcagaccagggttctggagctgcaggcccactgcgagaccctcgaggcgcagctccgcagggcagagtggagacaggctgacaccgccaaggagaaggacgctgccattgaccaacttcgtgaagatgcatcaactgtaaaatctgcctgggatgctcaaattgctcaactatctaaggagatggtctccagagaccttcagattcagacgctgcaggaagaagaggtgaagctcaaggcacaggtggcccgatcccagcaggacattgaaaggtacaagcaacagctgtccctggcagtggaaagggagcggagcctggagcgtgatcaggtgcagctgggcctggactggcagcgccgctgtgatgacattgaaagggaccagatccaaaagtcagaggccctgattcagggtctgagcatggcaaaaagtcaggttgctgccaagctgcaggagacagagcaggcgctacaggagcaggaggtggtgctgaaggccgtgaccctggaacgagaccaggccgtgcaggccctgaggatgcatgggctccccagaccaggggcacagatgcttctcaggcagcatgaagaagaaataagtaaagactttccatccagtgagatccagcggctccgagagcagaacacgagcttgcgaaacgcgattgcccagatgaggaaagaaatggaggctctaagccatcagattcctcctcccatccagacagcggcagagagcacagatgcaaaccagcctgacccagaggctgggggagatgccgccactcctgattatgttctggcccttgaagcagaaatacgaactctaaagcataagtttaaaactctggaaaagcatctagaagatgtgttggatcctttaaagatgtcctcacctcatgctgagtctcagcccagcgtccgcacctcgacagagacgactggagggtctgcccaagctggtcaagccggagggtctgtccaagctggtcaagcaggaggatctgtccaagctggcccagtatcctctggactggcactcaggaagctcggggacagagtgcagctcctaaacctgctggtgacacgactcagacagaaggtgctgcgggaacccctggagccggccgctctccagcgtgagcttccccgtgaggtggaccaggtacacctggaggttttggagctgcggaagcaggtggctgagctggggaagcatctcaggatagcccagcacgggggagcggagccttcaggcaggaagcagcccccagcctcggacgccgtggcccttgggagagaggtgggtgcccgctagctcctcctgccacccgccgaggttcctgccacagaaaccgtccttgcctgtgctctgccagcgttgctgtctgtatgccctgggagctcaggtgggacgagggctgcagtgaaggccgtgcctggaagtgggccctgctccaccccctctccccattcctccgccttcttcctccacacgcctcctcttctcctggtccttcaccttgatgccccgttggtggggggcgggacgggcccatcccagtcctcccttcagctaacagcatcttgtgttggaaacgca

SEQ ID NO: 121061 - DNA, 678 bp, Homo sapiens
  Payload ID: 3731
  Gene Symbol: CCDC57
  Gene Name: coiled-coil domain containing 57
  ENST ID: ENST00000392345
  CDS Start-End: 1-637
gggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagggccccattcattctggaacctgcagaccaactccatccgcccatcctcacagtgtgccgagcgccaggtccagaagcacgcacctacctgggggcctcttcctcctttctggcgggggtccgctttggcccctgatgctaacctcgccccgtgtgccgtgcagctggagtcaaacggaggcgcagagacgccatggagggtgacaagccacacagcaggagctcccagctcctccagcagccgacaggaggcccgtcaagatgcaggcaggcattgccaccccagggatgaagacagcagcccaggcaaaggccaagaccacaggagcctcccggtctcatcctgcaaaagctaaaggctgccagaggccccccaagatccgtaactacaacatta

SEQ ID NO: 121062 - DNA, 2964 bp, Homo sapiens
  Payload ID: 3731
  Gene Symbol: CCDC57
  Gene Name: coiled-coil domain containing 57
  ENST ID: ENST00000392346
  CDS Start-End: 548-1606
cccaaggagtggaggagggccaagccacgctggcgggagctgtcctcctgggtcctgggcactgctagaggccacagccttctctctgctctccctgggccgccttcctgggtcctgggcactgctggaggccacagccttctctctgctctccctggggagctgctgtgctggttgggtgtcctcagattctccttgtgttcacttgaaagacacaaaggcatagatgaccagaaggcagggatggcggggaggaggcggagggctgtgagggcctgggagatctgggggccaccctggcctgggagatctgtgggcctttattctatttgtggaagagaaggaacccactgaagcactgggagcagcgactctttttgtctttcttttggaaggatgtcacccagtgacagccagcagtgcccaccctggaagagcaggtgaagaggctccttgggtgggcacccctggcgtcctcccatgagggcagcctcacaggggtgtctgcctgtgagttttgttacagggcctcaccaagagagggcctatggaggccgaggaccagggggagcttttcctgcacctccggtcagtggcacgtgccccccagaccttatctatgcaccgactccagagaaagctgaaggaggcagccagaaaaatcatcagcctccgcctggagaaagagcagctcatcgagatggggaacaggctccgtgcagagctgggccgacccgaaaggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagaaatggggtctcactatgtcacccaggctggtctcgaactcctgggctcaagcagtcctgccgccttggcctcccaaagtgctgagatgacaggtgtgggccccacgcccagcctggcgtggagtggagcccttcacccaaacatgaaccaggaggcgagcttggtaaggagcacgtgggctccaggaatgcgagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcaggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtcttggaactttctgagaaacagatggtcaagtagatgtctgttagctcttttcttgaaattgtagtgacgaaaccatgactgccacttaggaaagtaacttgtgttgaaataacttttagaacaaagtaaatacattaagaaataaccaaatcggcttactttctgataatatttattctatgcccacacaacggctggcactcacttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaaggtgaaccctggggccctggccttctgcctgaaggccgtttctgggctgccggcacagggagggaagcagggcctgagcaaagctgagcacccttacggagctgagactgcactagggtctggggacacagaaggagccggcatttcagggcagaatcccgcaaggaggaaactgcagaaaagagctccagaaatctgcacagggttctcttgagtctgtactgaggaccagcctgtacatgtatagaagaaaactccacaaagccaggcaaagaggagaaaggagcatgtaaggtgaacaacttccagacctcgcacacggtcatgacatactgaagctccagccagggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtaatcccagaactttgggaagccgaggtgggcagatcacctgaggccaggagttcacaaccagcctggtcaacttggtaaaaccccgtctctactaaaaatacaaaaattagtcaggtgtggtggtgcatgcctgtaatcccaactactcaggaggctgaggcatgagaatcacttgaacctgggaagcagaggttgcagtgagccgagatcgcgccactgcactctagcctgagtgacagagcagactcctgtctcaaaaaa

SEQ ID NO: 121063 - DNA, 3000 bp, Homo sapiens; identical to SEQ ID NO: 121059
  Payload ID: 3731
  Gene Symbol: CCDC57
  Gene Name: coiled-coil domain containing 57
  Uniprot ID: Q2TAC2
  ENST ID: ENST00000392347
  CDS Start-End: 38-2788

SEQ ID NO: 121064 - DNA, 2829 bp, Homo sapiens
  Payload ID: 3731
  Gene Symbol: CCDC57
  Gene Name: coiled-coil domain containing 57
  ENST ID: ENST00000419322
  CDS Start-End: 1-1471
gcccagcgtccgcacctcgacagagacgactggagggtctgcccaagctggtcaagccggagggtctgtccaagctggtcaagcaggaggatctgtccaagctggcccagtatcctctggactggcactcaggaagctcggggacagagtgcagctcctaaacctgctggtgacacgactcagacagaaggtgctgcgggaacccctggagccggccgctctccagcgtgagcttccccgtgaggtggaccaggtacacctggaggttttggagctgcggaagcaggtggctgagctggggaagcatctcaggatagcccagcacgggggagcggagccttcaggcaggaagcagcccccagcctcggacgccgtggcccttgggagagagggcctcaccaagagagggcctatggaggccgaggaccagggggagcttttcctgcacctccggtcagtggcacgtgccccccagaccttatctatgcaccgactccagagaaagctgaaggaggcagccagaaaaatcatcagcctccgcctggagaaagagcagctcatcgagatggggaacaggctccgtgcagagctgggccgacccgaaaggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcagacttgacgccctgcaaggcccgaagacacaacacagcatccacacggtgacctgtaaatcacctcggcagaaagaagacaggtccccaaagccaccccaggctccccagcaccctgaggagcatggtcgccaatcccacagctcctcctcctttgccagtggcaccctccaggacatgtggaggttgctagacctgggatccagcccttctggtgtcacctcccagggtgactcaactccagaaatggggtctcactatgtcacccaggctggtctcgaactcctgggctcaagcagtcctgccgccttggcctcccaaagtgctgagatgacaggtgtgggccccacgcccagcctggcgtggagtggagcccttcacccaaacatgaaccaggaggcgagcttggtaaggagcacgtgggctccaggaatgcgagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcaggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtcttggaactttctgagaaacagatggtcaagtagatgtctgttagctcttttcttgaaattgtagtgacgaaaccatgactgccacttaggaaagtaacttgtgttgaaataacttttagaacaaagtaaatacattaagaaataaccaaatcggcttactttctgataatatttattctatgcccacacaacggctggcactcacttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaaggtgaaccctggggccctggccttctgcctgaaggccgtttctgggctgccggcacagggagggaagcagggcctgagcaaagctgagcacccttacggagctgagactgcactagggtctggggacacagaaggagccggcatttcagggcagaatcccgcaaggaggaaactgcagaaaagagctccagaaatctgcacagggttctcttgagtctgtactgaggaccagcctgtacatgtatagaagaaaactccacaaagccaggcaaagaggagaaaggagcatgtaaggtgaacaacttccagacctcgcacacggtcatgacatactgaagctccagccagggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtaatcccagaactttgggaagccgaggtgggcagatcacctgaggccaggagttcacaaccagcctggtcaacttggtaaaaccccgtctctactaaaaatacaaaaattagtcaggtgtggtggtgcatgcctgtaatcccaactactcaggaggctgaggcatgagaatcacttgaacctgggaagcagaggttgcagtgagccgagatcgcgccactgcactctagcctgagtgacagagcagactcctgtctcaaaaaa

SEQ ID NO: 121065 - DNA, 491 bp, Homo sapiens
  Payload ID: 3731
  Gene Symbol: CCDC57
  Gene Name: coiled-coil domain containing 57
  ENST ID: ENST00000581625
  CDS Start-End: 1-106
tgacaagaatggtgagattgaccaccaccgggaacagtatgaaaatctaaaatggacactggagagaaaacttgaggagctcgacggaactgctgctggagtttgaatcgaaaatgcggaagagggagcacgaattccgtctgcaggctgacaacatgagcaacacagccttgtcccgggagcttaaggttaaactactgcacaaagagctggaggctctgaaggaagccggggcaaaggctgcagagagtctgcagagggcagaggccaccaacgccgagctggagaggaagctccagagccgagccggggagctccaggacctggaggccatgagccgcgcccgggtaaaggatttagaggataaacttcactctgtgcagctaaccaggaagaaggaagaggaaacatttaagaggaagcatgaggagctcgaccgtctggccagggagaaggatgcagtgctggtggcggtgaagggagcccacgtg

SEQ ID NO: 121066 - DNA, 188 bp, Homo sapiens
  Payload ID: 3731
  Gene Symbol: CCDC57
  Gene Name: coiled-coil domain containing 57
  ENST ID: ENST00000583053
  CDS Start-End: 1-136
agcagccgacaggaggcccgtcaagatgcaggcaggcattgccaccccagggatgaagacagcagcccaggcaaaggccaagaccacaggagcctcccgggcaggctcccaaatgctgctgaggcgaccctgctgactgaaggcctccctgagcacagggcccattaaaaccaggttcctccctgggg

SEQ ID NO: 121067 - DNA, 429 bp, Homo sapiens
  Payload ID: 3731
  Gene Symbol: CCDC57
  Gene Name: coiled-coil domain containing 57
  ENST ID: ENST00000583593
  CDS Start-End: 1-165
gaggagcatggtcgccaatcccacagctcctcctcctttgccagtggcaccctccaggacatgtggaggttgctagacctgggatccagcccttctggtgtcacctcccagggtgactcaactccagaacttcattctgtcctaaaggaagcagtcgcagcttaaagagtgtgagcacgcgcccactccccacagacacacccggcctgccccgccccacgctgcccctgccctggagaaagcgaggctccttcctttcctggagacgccggccacagttcttcagtgaaacgcttcactctctggtcatagagagctcccagctcctccagcagccgacaggaggcccgtcaagatgcaggcaggcattgccaccccagggatgaagacagcagcccaggcaaaggccaagaccacaggagcctcccg

SEQ ID NO: 121068 - DNA, 720 bp, Homo sapiens
  Payload ID: 3732
  Gene Symbol: CCDC58
  Gene Name: coiled-coil domain containing 58
  Uniprot ID: Q4VC31
  ENST ID: ENST00000291458
  CDS Start-End: 8-442
gtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgtaaaaaaaaaaaaaaaaaatttttgtaactattaaaataattttctgactcagtgta

SEQ ID NO: 121069 - DNA, 431 bp, Homo sapiens
  Payload ID: 3732
  Gene Symbol: CCDC58
  Gene Name: coiled-coil domain containing 58
  ENST ID: ENST00000479414
  CDS Start-End: 1-424
aaaggagttggtttcagtcatggatttaagtttggcaaaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagaga

SEQ ID NO: 121070 - DNA, 545 bp, Homo sapiens
  Payload ID: 3732
  Gene Symbol: CCDC58
  Gene Name: coiled-coil domain containing 58
  ENST ID: ENST00000479899
  CDS Start-End: 72-464
aatatggcggcgcccagtggcggtgtgaactgtgaggagttcgccgagttccaggtgatggggttttcctcatgtggcaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttttttttttttaaggactgggtcatctcataagagctaagcatgacagatatca

SEQ ID NO: 121071 - DNA, 438 bp, Homo sapiens
  Payload ID: 3732
  Gene Symbol: CCDC58
  Gene Name: coiled-coil domain containing 58
  ENST ID: ENST00000497726
  CDS Start-End: 8-169
gtccaatatggcggcgcccagtggcggtgtgaactgtgaggagttcgccgagttccagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgtaaaaaaaaaaaaaaaaaatttttgtaactattaaaataattttctga

SEQ ID NO: 121072 - DNA, 1983 bp, Homo sapiens
  Payload ID: 3733
  Gene Symbol: CCDC59
  Gene Name: coiled-coil domain containing 59
  Uniprot ID: Q9P031
  ENST ID: ENST00000256151
  CDS Start-End: 413-1138
ctgagggcagggcctccgtctccgacgctgacttcctcagcgcagccagcactgtctccggtggcaagtcgaccagctcctcccacacggattctgtgtagaaatccacggtatgtgcattggaaatggacagggcatccctcaggaactgcagcagtccctgcaacttggcacgcagcgtgggcaggtccggggtcaccgggagagggcaagaagccgccatgacgctcaccctccgaggctgtaggtggcgcaaacatggccgtgaggcgccagctcggcccaaattagcacaggcaggctcagtagagctccgagccggattccttctgagcgattgattgcttcggcttggtgacgtattttgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaattccaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaatcagagctatcaatgaagcatttcaatgaaatatttcaatttagtaaacagttacgttgttttaaaatttattttaatgatgagggaggcaaagactcctcttggactttttatttattttaagtacatgttacagggtgatgggtgctgaaataaactgccctcaccatataacaaagcgaccttcacaaagcagtgaactcaaagtctgatatttataaacattcccttaaatggatgtacatggcttgttagtctaaggtcttttaaataatgatggaaaccccacagtgtcacagcaagaattaagctttccagttcctatggaccctatactttaagaacattatctctgtctcccttgttggtacccttgtgagctgagataagccactgggataactgcttctcatgctttgcaaattgcagaagaatgagaaaggcttgaaatatatatatagtcattgtaagcaaaaagggctgaccaataatacttgccaaatattgaataataaaattttataaatgatagc

SEQ ID NO: 121073 - DNA, 563 bp, Homo sapiens
  Payload ID: 3733
  Gene Symbol: CCDC59
  Gene Name: coiled-coil domain containing 59
  ENST ID: ENST00000552377
  CDS Start-End: 21-563
gacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaaatctgagtttctgacctgtacattttcattctctctgaggaatgtctttcaacatttcttgcaagtctttgggaaccag

SEQ ID NO: 121074 - DNA, 5811 bp, Homo sapiens
  Payload ID: 3734
  Gene Symbol: CCDC6
  Gene Name: coiled-coil domain containing 6
  Uniprot ID: Q16204
  ENST ID: ENST00000263102
  CDS Start-End: 233-1657
agtgcaatactgcccaagcccgggcggggtctctgttctctggcagaggaggtcccttggcagcgggaagcgccctctctttctctcgccgccgctccgagtctgcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgtgaccatccaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcagttgcagcatgagaaagccgaactagaacagcatcttgaacaagagcaggaatttcaggtcaacaaactgatgaagaaaattaaaaaactggagaatgacaccatttctaagcaacttacattagaacagttgagacgggagaagattgaccttgaaaatacattggaacaagaacaagaagcactagttaatcgcctctggaaaaggatggataagcttgaagctgaaaagcgaatcctgcaggaaaaattagaccagcccgtctctgctccaccatcgcctagagatatctccatggagattgattctccagaaaatatgatgcgtcacatcaggtttttaaagaatgaagtggaacggctgaagaagcaactgagagctgctcagttacagcattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccgcctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtaaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagatagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagaattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgta

SEQ ID NO: 121075 - DNA, 2450 bp, Homo sapiens
  Payload ID: 3735
  Gene Symbol: CCDC60
  Gene Name: coiled-coil domain containing 60
  Uniprot ID: Q8IWA6
  ENST ID: ENST00000327554
  CDS Start-End: 466-2118
agttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccgctttttgatccagtctgtgaagataggccgtggatattttgctattctgagggaagagactgcaaagaaaaagaagcaacaacaacttcagaaactgaaagaggaggaaagaaataaattccagccagccgaaaagatctcagaaatccactatggggacaccttattgagcacatatgatgatgagaagttgaagacactgggagctagagtcacacgtcgcccattcactcccatccacagctgcatcatttctccctcgctaaccgaggctcacgtcgagcccctcttccgccagctctgtgctctccactggcttctggaggccctgactattgaccacacccaccacaccatgaagcctgtgatcacctgctggaacccaaaggacccgggtggaagcaagagcaccattaaaaaaatcaataaggacaagtccatgggacagaaatgggagcatttcatcacagcgccaaagaccaagaaattcaaaattcccacaatgcgagtcaccaaccgcaaaccaagccggcgaggctccacactcagtctgagtcgggccagtggggggtcctctccccagagcagcatgatctctgtgaaccctggctcggatgagcccccaagtgtgaacacccaggtgaccagcagcaaggacattgaggacaatgagtcatcttcaaccaagccagatgaagaacctctgtatatgaatctgcagaagctcctggagatggttcgggaagatgcccggaggacagtcacaatagaaaatgggatgcaaagaaaagcacccagcatcttgtcagtgctgaaacaaaacaagagtaattctgcttataaggaaatgcagaccactctcaaatcaagtgagagatccagcagtacaagtgcagaaagccacatccaaccagtccagaagaagtctaaaaaccgcactaattgtgacatcaacatccactacaagagtggggtgtgtaacaccatgagggccaagttttacagcgtagcccaggaggctggcttctgcctgcaggacaagatggaaatcctcatgaagcgccaagaagagagaggtatccagaagttccgtgcttttgtccttgtctcaaattttcaaaaggacatagcaaaaatgagacatcacatatctgtagtaaaaggagatgcagaagaaattgcagaccactggtactttgatctgttgtccaaactgccagaggatctaaagaacttccgccccgccaaaaagatcctggtgaaactgcagaagtttggagaaaacctggacttgcggattcgaccccatgtcctcctgaaggtgctgcaggatctgaggatttgggaactgtgctcccctgacatcgctgtggctattgagtttgtgcgagaacacatcatccatatgcctcaagaggattacatcagctggctgcagagccggatcaacatacccattgggccctacagcgccctgaggtaggctgggcctgggttgaccagctgtctcagtggaggagtgtttgcctatatcatgttcctgtatcctgcctgtgttcctgcctcctgactaccctcatggatgctctttatggatgaccctttacagtagggtcatctggagactgacttccagcaacatttttagagggggatggccccggtggccctcccctcaattccacaccccagacccaacctaccagtctctgttcttcaatgatccagcctgactctacctacttcctcttcagattccttcaccctatttaccttcctcaagtactggagaataaaattgaactgaatgtttga

SEQ ID NO: 121076 - DNA, 581 bp, Homo sapiens
  Payload ID: 3735
  Gene Symbol: CCDC60
  Gene Name: coiled-coil domain containing 60
  ENST ID: ENST00000539847
  CDS Start-End: 249-422
tttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccggtgagtgagcccagcagggaatgatccatagacaacccaacaggcatgagcaggctatggggtgttgcctacaagtccttgcccagtcccagcatcccccaattctgaacactaagcagaagacttacaggagggtaaccctgggaggagcagagggcaggat

SEQ ID NO: 121077 - DNA, 886 bp, Homo sapiens
  Payload ID: 3735
  Gene Symbol: CCDC60
  Gene Name: coiled-coil domain containing 60
  ENST ID: ENST00000536742
  CDS Start-End: 466-867
agttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccgcctctcccactgccggacacaaaggagaatggggaaaaggccaaacagagaagccacaagcaagcaagaaagaaacgacaatgagatgttccatctggccacacttctggatcccaccaacattaaggaaggaatcaggattccccttcagaaggaaacaccatgttttccaagggaagtcatctctccaagtggcacaaactccctgaccccatatcccagtattaaatgaggcgaattgttaacaaaga

SEQ ID NO: 121078 - DNA, 1282 bp, Homo sapiens
  Payload ID: 3736
  Gene Symbol: CCDC61
  Gene Name: coiled-coil domain containing 61
  Uniprot ID: Q9Y6R9
  ENST ID: ENST00000536603
  CDS Start-End: 56-1054
ttcgtcagttgaaccgctcgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctgggg

SEQ ID NO: 121079 - DNA, 1017 bp, Homo sapiens
  Payload ID: 3736
  Gene Symbol: CCDC61
  Gene Name: coiled-coil domain containing 61
  Uniprot ID: Q9Y6R9
  ENST ID: ENST00000594087
  CDS Start-End: 14-1012
agcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtgg

SEQ ID NO: 121080 - DNA, 800 bp, Homo sapiens
  Payload ID: 3736
  Gene Symbol: CCDC61
  Gene Name: coiled-coil domain containing 61
  ENST ID: ENST00000596687
  CDS Start-End: 38-187
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggctagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagaggggg

SEQ ID NO: 121081 - DNA, 433 bp, Homo sapiens
  Payload ID: 3736
  Gene Symbol: CCDC61
  Gene Name: coiled-coil domain containing 61
  ENST ID: ENST00000594672
  CDS Start-End: 203-433
gaaccgctcgcgaggagggttgctagtggagaagcctggatctctgccctgaactccagactcatatcatggccgactcttctctctttggaagttcatctgacattcagacataaacttgtcccaaaccaatcttgcgatttcttcctttcaacctccaaacccagttgatgggacattcatcctgccagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcag

SEQ ID NO: 121082 - DNA, 1817 bp, Homo sapiens
  Payload ID: 3736
  Gene Symbol: CCDC61
  Gene Name: coiled-coil domain containing 61
  Uniprot ID: Q9Y6R9
  ENST ID: ENST00000595358
  CDS Start-End: 50-1588
agttgaaccgctcgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctgggga

SEQ ID NO: 121083 - DNA, 3546 bp, Homo sapiens
  Payload ID: 3737
  Gene Symbol: CCDC62
  Gene Name: coiled-coil domain containing 62
  Uniprot ID: Q6P9F0
  ENST ID: ENST00000253079
  CDS Start-End: 345-2399
gccggttctttcaggccttccagcgccggagcctcgggcgtgggcaaaaagcgtccatacgcagcctgagccacttgggagcccccagtttccgaggcagaagaacagtgcccaccagcgcagcggggctgcggcccggaaaccctggcggggagccccgagccccggcgggcgcacgccgcgtgggcaccaggcaggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgttaacaggtctcagtgttacttcagagatgattttcatgagcggggaagagccacctcatttagcctttttaattagggtgctgaaaagagaagttgggtgaggtttggttatgttctttatcaatgcgtgctttctccctcaggctgggct

SEQ ID NO: 121084 - DNA, 2479 bp, Homo sapiens
  Payload ID: 3737
  Gene Symbol: CCDC62
  Gene Name: coiled-coil domain containing 62
  Uniprot ID: Q6P9F0
  ENST ID: ENST00000341952
  CDS Start-End: 144-2192
ttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgagtaaaataaggaaggaacgttcatcactttaaactgaacctggcaagttaatttcctcaggaatggggatgtatttttttaagcattgcagatatcaaagttctattgtgctgaataaatgcccctttgttaacagg

SEQ ID NO: 121085 - DNA, 2266 bp, Homo sapiens
  Payload ID: 3737
  Gene Symbol: CCDC62
  Gene Name: coiled-coil domain containing 62
  ENST ID: ENST00000392440
  CDS Start-End: 31-1524
cacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaa

SEQ ID NO: 121086 - DNA, 2936 bp, Homo sapiens
  Payload ID: 3737
  Gene Symbol: CCDC62
  Gene Name: coiled-coil domain containing 62
  Uniprot ID: Q6P9F0
  ENST ID: ENST00000392441
  CDS Start-End: 146-2194
ggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaa

SEQ ID NO: 121087 - DNA, 331 bp, Homo sapiens
  Payload ID: 3737
  Gene Symbol: CCDC62
  Gene Name: coiled-coil domain containing 62
  ENST ID: ENST00000539171
  CDS Start-End: 140-331
agtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaattt

SEQ ID NO: 121088 - DNA, 3537 bp, Homo sapiens
  Payload ID: 3737
  Gene Symbol: CCDC62
  Gene Name: coiled-coil domain containing 62
  Uniprot ID: Q6P9F0
  ENST ID: ENST00000537566
  CDS Start-End: 1203-2540
tattgtctttgggtacatgtgaaagatttccttacataatttattttttaatgatgtatgttgtatttggatcagttacaatattaaattgcccttaatagattgagtatgtatagatgccttagatgttgtagttgtcatgcatattgaacactggaagacttaattttctttttatagactaaaattcccattgtttagtaaggatcatttacatttaaacagtaactatttcgtgattttgtttggttttttttgatagagttttgctcttgttgcccaggctagagtgcaatggcacgatctcggctcactgcaacctctgcctccagggttcaagcagttctcctgcctcagcctcttgagtagctgggattacaggcgcatgccaccacactgagctaatttttgtatttttagtagagatggggttttgccacgttggccaggctggtctcgaactcctgacctcaggtgatcggcccaccttgacctcccaaaatgctggaattacaggcgtgagccaccacgcctggccactatttcatgtttacctgtacttggttactcaaattgctggggcaaggtaggggataatgttattgactggcagagaaaagggttgttggcaaagggggagaaaaagtgcagaaataggtttatttgtttacccagtgggttttagaaacagtcccactttttaggcatggtacgtatggcatgacagaaaattgtagagaggcagagtgcatggtagattttaacttgaacatgttttaagtatacataatcttttgctgccatgttattaaaacttaattgaactacttagaattggccgcaaaagaagatatacttatttggaaaatggactttggctgatttgttattgatttcattctattttgatgtgaaaccgctttctatgtttagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaagtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgtt

SEQ ID NO: 121089 - DNA, 1993 bp, Homo sapiens
  Payload ID: 3738
  Gene Symbol: CCDC63
  Gene Name: coiled-coil domain containing 63
  Uniprot ID: Q8NA47
  ENST ID: ENST00000308208
  CDS Start-End: 243-1934
agaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactgggcattgcagagagacagagagagagaggaaggctcactggctttgagctctctgggtacagtgtctgagtggaggcaaagtgcggttccttcaagatgtctgtgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgta

SEQ ID NO: 121090 - DNA, 1887 bp, Homo sapiens
  Payload ID: 3738
  Gene Symbol: CCDC63
  Gene Name: coiled-coil domain containing 63
  Uniprot ID: Q8NA47
  ENST ID: ENST00000545036
  CDS Start-End: 258-1829
agaacgcccgggcgtggggctgggggtgtggcgcagcgaggccgcgcagcaagcagtcctcccggcaccgtcggaagcgcagttgcagcagccgtcggacaagcggccggagcagccacggacaagcagtccgggccccgccactgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgt

SEQ ID NO: 121091 - DNA, 1651 bp, Homo sapiens
  Payload ID: 3738
  Gene Symbol: CCDC63
  Gene Name: coiled-coil domain containing 63
  ENST ID: ENST00000552694
  CDS Start-End: 138-1592
ccgtcggaagcgcagttgcagcagccgtcggacaagcggccggagcagccacggacaagcagtccgggccccgccactgcaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagtgctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgta

SEQ ID NO: 121092 - DNA, 3055 bp, Homo sapiens
  Payload ID: 3739
  Gene Symbol: CCDC64
  Gene Name: coiled-coil domain containing 64
  Uniprot ID: Q6ZP65
  ENST ID: ENST00000397558
  CDS Start-End: 1-1722
atgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggctttagccatccagccctttcccctgctcagggctggggttggacggggtctcctcctcccacagctccctcctccacccctcacatacatacataatttcttggcctagccaaacaagtccaggccactgaatggcaccagaggggtctgtggtcagccaccccaccttgagggcagcacaggcaccacggggtggaggggagggggaggctgccggaagcctccagatgctgcctgcctgcctgcagaagcctgcagtggctgctgctcctgcctctgcagccgcccctcctcctccacccaggccccaactcagaggctccgcggcccggccagccctcagctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacaga

SEQ ID NO: 121093 - DNA, 1109 bp, Homo sapiens
  Payload ID: 3739
  Gene Symbol: CCDC64
  Gene Name: coiled-coil domain containing 64
  ENST ID: ENST00000548673
  CDS Start-End: 1-876
gagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagaggggtaaactgaggcaaagcctagaagagctgcagcgactccacagtcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacg

SEQ ID NO: 121094 - DNA, 747 bp, Homo sapiens
  Payload ID: 3739
  Gene Symbol: CCDC64
  Gene Name: coiled-coil domain containing 64
  ENST ID: ENST00000547841
  CDS Start-End: 1-232
caaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcagtttgcttcctcagggctttttactatctggctcctttggtttctgatctagtggcctttctcagttcccgtatcaacagctttagttgtacacccctcctgcctttgaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggcccctt

SEQ ID NO: 121095 - DNA, 2397 bp, Homo sapiens
  Payload ID: 3739
  Gene Symbol: CCDC64
  Gene Name: coiled-coil domain containing 64
  ENST ID: ENST00000546420
  CDS Start-End: 1-685
ctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagcctgggtctctggccgagggggccggaccgcagccgccgccctcccaggaccccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcaggaaaattaagacttggatttactattctacctcagcccttcttgtatattgaaaataaaactaccaactcttcagttaccggaggaaaaagaacttctctgatatcatccctcagcactgatgttctcatgggagcagtgccgtgtctgcatggtctcctctgtttcaggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcaggtgacactgctgagtgtggagatgactgccctaaaagaggagagagaccgactcagagtcacttctgaggacaaggagccaaaggagcagcttcagaaggccatcagggaccgcgacgaggccattgcaaagaagaatgctgtggagctggaacttgccaagtgcaggatggatatgatgtctctgaacagccagttgctggatgccattcagcagaaactgaacctctcgcagcagctggaagcttggcaggatgacatgcacagggtcattgaccggcagctgatggacacgcacctgaaagaacggagccagccggctgctgccctctgcaggggccacagcgctgggcggggggatgagcccagcatcgctgaaggcaaacgactcttctcattcttcaggaaaatttaagttgggaggagtcaggccaccaaagatgggtggactggaggcagctggaaaggcggtgcaggcaaggcctcccctgcagcttgcacctcagcagctgccctgcccctcatgctagggccccatgggtccgggagggcctgctccctttcgtcggtggggatggagacctagaggtgggggcctgccttggccactgaaggcttcccttggcccaccgcctggccaagcccacgcctgggcttctccaggaccacgtgcttgagcagggttaggccacctcccagaggggccccttggtgttgggctttgcagctcacacccaacagatcgcagcccacccccaggcactgctgcctccttgattttagcaaatggggaacagaaggaatggaggcccttctctgcatgcctcaggaggcctgagccccaggggcctagacctgtgggggcagcgggccaggcctgagcctccattccttccccagcccctggcccagggtcaaaggagagatggcagcccctcccccgcatgcatgcacctcagctggcaggaggccaagcctctggccgcagggtctaagagccggggcttacccaagctcagctgaggccacccgagccccagggaggaagaaggccctgtccccctgtcgccactgctctccctcccagccttcagtctctgccccttagcagggcctggccaggcagagtgttatcaccagtcatctgcaggc

SEQ ID NO: 121096 - DNA, 1811 bp, Homo sapiens
  Payload ID: 3740
  Gene Symbol: CCDC64B
  Gene Name: coiled-coil domain containing 64B
  Uniprot ID: A1A5D9
  ENST ID: ENST00000389347
  CDS Start-End: 46-1572
tagagtgtcccgcagccacctgtccccgcagatgctgcaggtgacatgagctctccagatgggcccagcttcccgtccgggccgctctcagggggcgcctctcccagcggcgacgagggcttcttcccctttgtgctggagcggcgggactcattcctgggagggggcccagggcctgaggagcccgaggacctagccttgcagctgcagcagaaggagaaagacctgctgttggccgcggagctcggcaagatgcttctggagcgaaatgaagagctgcggcggcagctggagacgctgagcgcccagcacttggagcgtgaggaacggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggcctcccagactgagcaggaacttcagagggaactggacgcccttcggggacagtgccaggctcaggcactggctggagcagagctgaggacgcggctggagagtctgcagggggaaaaccagatgctgcagagccgccggcaggacctggaggcccagatccgaggcctgcgtgaggaggtggagaagggtgagggcagactgcagaccacccacgaggagttgctgctgctgaggcgggagcggcgggagcacagcctggagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatata

SEQ ID NO: 121097 - DNA, 1984 bp, Homo sapiens
  Payload ID: 3740
  Gene Symbol: CCDC64B
  Gene Name: coiled-coil domain containing 64B
  Uniprot ID: A1A5D9
  ENST ID: ENST00000572449
  CDS Start-End: 64-1590
gcggggacctcggagggagcccggcggcttcggccacctgtccccgcagatgctgcaggtgacatgagctctccagatgggcccagcttcccgtccgggccgctctcagggggcgcctctcccagcggcgacgagggcttcttcccctttgtgctggagcggcgggactcattcctgggagggggcccagggcctgaggagcccgaggacctagccttgcagctgcagcagaaggagaaagacctgctgttggccgcggagctcggcaagatgcttctggagcgaaatgaagagctgcggcggcagctggagacgctgagcgcccagcacttggagcgtgaggaacggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggcctcccagactgagcaggaacttcagagggaactggacgcccttcggggacagtgccaggctcaggcactggctggagcagagctgaggacgcggctggagagtctgcagggggaaaaccagatgctgcagagccgccggcaggacctggaggcccagatccgaggcctgcgtgaggaggtggagaagggtgagggcagactgcagaccacccacgaggagttgctgctgctgaggcgggagcggcgggagcacagcctggagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatatacgtctatcttttctagggcagggatggggctgggtatttatgtatcaagatcggacagagtaatatataaatcactccaccgatttggcccccattcatagaaagaaagagcatggtaaaaaagcctgaaactttattgtaaaaaaaaaaaaaaa

SEQ ID NO: 121098 - DNA, 3519 bp, Homo sapiens
  Payload ID: 3740
  Gene Symbol: CCDC64B
  Gene Name: coiled-coil domain containing 64B
  Uniprot ID: A1A5D9
  ENST ID: ENST00000573514
  CDS Start-End: 2192-3097
cctggagcccgttctctaagggacagcccaggactttcaaaaactgcaaatcagatcatttcactcctcaaccagaatctccccctcacacttagaatgaaaccaaaacccttccccagggcctaaaagtcccagagaactgggctcctccccgacctcatcacagcagcaccacccctttctcccctcctccaagaagggcagccgaaccaccctctccccgacaatgagggctcttttcatttcctccaagaactcacgcttgttccctcaggaactttgcacttgctgttccttaatgcctagccttctttctggtggctcttcttgtcctgcagaagtcgactcaaacatgacgtcctccttgaaggaccctccacccccaccccactccttactctctatcatttcccgggtctctttacagcccttactgtctccctgaaactacctggctccggcatgtgtccatgccctctggactctaagctgcttgaagcagtgaacttggtggtctcacgtgccactgacagcagaccccagaacaagtggagctcaggaaatgtgggaggattgatagcagtgtgggtggatagacttagagatattgtgtccaggccacaaggcatcagcagagccgagcatcagccaggacaatctgaccttgaacctgacagcttaatcctgaagctgtgttgcctctgcagtattcggttaagagttctgctgcctgagttggcatccctgctttgtgaagttattgtgtgtcggctgggcacggtgtctcatgcctgtaatcccagcactttgggaggccgaggagggtggatcgcttaaggccaggagttcaggaccagcctggccaacatggtgaaaccccgtctctcctaagaaaacaaaaaaatttgccgggcagggtggcgcacgccagtaatcttagctacttgggaggctgaggcaggagaatctcttgaacttgggaggcggacattgccgtgagctgagatagtgccactgcgctctagcctgggccaaagagtaaagatctgtctcaaaataaataaataaataaaaaataaaaacaacaataaatgactgtgtgtccttaggcaaggcacttagcaactcttgagcttgttccatctgtaaacccaggacgttagtgattctccctctagtggatgaaatgaagcaatgcagatagagccctaatgcagggtacctgcgagtcgctgcagcagctgtggcaattgtcaccttcatccaggcccatcccgctttgagggcctagagagagtgggccagaggttaacccccgattcatctgcctccccacgctgggcatctgggtgtgccagggcattcccccgctggtcagacaggtttttgggccagggcggggctgaccagggttaattagagggaactggctaggaggagctggggagggggctgggcagagtccaggcctccagagcccctgggacacagcaggtgtgtgctgccatgggccggggcttgaactctgccagactcaggcgccaaaaacggcgcttgcgacctcaggtccagaagccccggcagcagctggaggtgagtggtcatcagagatccccccaccccaacccttgccccgggcccacgcgtcctgtctgctcggaaccttccctctaaatctctgggtcttgctcacgcttcctccctcactctcccttgcttttgtgtctgtcttggacacaaggcccccttaggctttctccctaggtgtctgtccctccatcgccatctctctgtgcctgcccagtctcatcggtgcctctctgcctctgtccctctgccctggcccccacagcggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggcctcccagactgagcaggaacttcagagggaactggacgcccttcggggacagtgccaggctcaggcactggctggagcagagctgaggacgcggctggagagtctgcagggggaaaaccagatgctgcagagccgccggcaggacctggaggcccagatccgaggcctgcgtgaggaggtggagaagggtgagggcagactgcagaccacccacgaggagttgctgctgctgaggcgggagcggcgggagcacagcctggagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatatacgtctatcttttctagggcagggatggggctgggtatttatgtatcaagatcggacagagtaatatataaatcactccaccgatttggcccccattcatagaaagaaagagcatggtaaaaaagcctgaaactttattgtaaaaaaaaaaaaaaaaagaaaatgaaaaacactctaaaaccct

SEQ ID NO: 121099 - DNA, 2084 bp, Homo sapiens
  Payload ID: 3741
  Gene Symbol: CCDC65
  Gene Name: coiled-coil domain containing 65
  Uniprot ID: Q8IXS2
  ENST ID: ENST00000266984
  CDS Start-End: 228-1721
gatatcctcgttgctaggagactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggcagcacaagcccatctgcaccctggagggaccagagaaggagctttttccttggatcaagttagaagaaatccaaacaacagagaaaggtgagatgattcttggaaagataggagagttggcccacccctggctggagatacaacttaatcacagaaccattgctagaaaagcctccacactcaaaggtgtctctgtcagtgtgtaggagaaaccctaccacagtacctgggcttccaagactcatggggcacccaccatgcccagcttgattaaagacaatggtgtttattaattcatccatttgttcatcaaggttgcatgactattatgtgccaaagaataagcagaacactgctctttaaatgttcttaagtgtttatttataacaggttgttaataaagtaaaagcctgagttggcatatat

SEQ ID NO: 121100 - DNA, 1775 bp, Homo sapiens
  Payload ID: 3741
  Gene Symbol: CCDC65
  Gene Name: coiled-coil domain containing 65
  Uniprot ID: Q8IXS2
  ENST ID: ENST00000320516
  CDS Start-End: 189-1643
gggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagttt

SEQ ID NO: 121101 - DNA, 1338 bp, Homo sapiens
  Payload ID: 3741
  Gene Symbol: CCDC65
  Gene Name: coiled-coil domain containing 65
  ENST ID: ENST00000552942
  CDS Start-End: 219-1338
gttgctaggagactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccag

SEQ ID NO: 121102 - DNA, 1746 bp, Homo sapiens
  Payload ID: 3741
  Gene Symbol: CCDC65
  Gene Name: coiled-coil domain containing 65
  ENST ID: ENST00000547861
  CDS Start-End: 205-333
agacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatgg

SEQ ID NO: 121103 - DNA, 3027 bp, Homo sapiens
  Payload ID: 3742
  Gene Symbol: CCDC66
  Gene Name: coiled-coil domain containing 66
  Uniprot ID: A2RUB6
  ENST ID: ENST00000326595
  CDS Start-End: 139-2883
aaccgacgtacacaaggggcttgagcgttctgtggagagagtgcgagagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaa

SEQ ID NO: 121104 - DNA, 3042 bp, Homo sapiens
  Payload ID: 3742
  Gene Symbol: CCDC66
  Gene Name: coiled-coil domain containing 66
  ENST ID: ENST00000341455
  CDS Start-End: 25-717
gtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaa

SEQ ID NO: 121105 - DNA, 3096 bp, Homo sapiens
  Payload ID: 3742
  Gene Symbol: CCDC66
  Gene Name: coiled-coil domain containing 66
  Uniprot ID: A2RUB6
  ENST ID: ENST00000394672
  CDS Start-End: 71-2917
ctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatactt

SEQ ID NO: 121106 - DNA, 709 bp, Homo sapiens
  Payload ID: 3742
  Gene Symbol: CCDC66
  Gene Name: coiled-coil domain containing 66
  ENST ID: ENST00000439445
  CDS Start-End: 81-263
gtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaatagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttcta

SEQ ID NO: 121107 - DNA, 2413 bp, Homo sapiens
  Payload ID: 3742
  Gene Symbol: CCDC66
  Gene Name: coiled-coil domain containing 66
  ENST ID: ENST00000434467
  CDS Start-End: 34-216
gagcgttctgtggagagagtgcgaggtcaggccatgaacttgggagatggtttaaagcttgaaactgaattactggatggaaaaaccaagctaatattgtctccatatgaacataaatcaaaaatttctgtgaagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaatagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtagagaatgaatggaaaccagctgatatattcagtactctgggggaaagggaatgtgatagaagttcgttggaagcaaaaaaagcccagtggaggaaagagctagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatatt

SEQ ID NO: 121108 - DNA, 1983 bp, Homo sapiens
  Payload ID: 3742
  Gene Symbol: CCDC66
  Gene Name: coiled-coil domain containing 66
  ENST ID: ENST00000422222
  CDS Start-End: 83-1983
gcgtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctaggggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaa

SEQ ID NO: 121109 - DNA, 762 bp, Homo sapiens
  Payload ID: 3742
  Gene Symbol: CCDC66
  Gene Name: coiled-coil domain containing 66
  ENST ID: ENST00000422788
  CDS Start-End: 25-141
gtggagagagtgcgaggtcaggccatgaacttgggagatggtttaaagcttgaaactgaattactggatggaaaaaccaagctaatattgtctccatatgaacataaatcaaaaatttctgtgaaggctgatttgttatagaagccacatttgtgaagacattttattgtcattttaaccaactcagaacatctgaagatcccctttataggcctataataaacagaattactggtcttggatttttgatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaactgggcatagagacaattcatgaaaaggttttccactgatttcacagctaaataagaaaaataacgtcaagg

SEQ ID NO: 121110 - DNA, 3120 bp, Homo sapiens
  Payload ID: 3742
  Gene Symbol: CCDC66
  Gene Name: coiled-coil domain containing 66
  ENST ID: ENST00000471681
  CDS Start-End: 116-979
agcgttctgtggagagagtgcgagagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctaggctcttcaagcattctatcacagtctcgtagccaggttatggtggtccaagctgatggggcattcacaacttagagctagtcagactttagaggaaacagtactgctggagcaccctttcagtgctgtgaaacaagaactgcaaagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgacttctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaa

SEQ ID NO: 121111 - DNA, 2664 bp, Homo sapiens
  Payload ID: 3743
  Gene Symbol: CCDC67
  Gene Name: coiled-coil domain containing 67
  Uniprot ID: Q05D60
  ENST ID: ENST00000298050
  CDS Start-End: 101-1915
atacgcggtcctgcgccctcgcctcagacctctcgggcgagcgcggcgcagcgcagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattc

SEQ ID NO: 121112 - DNA, 1871 bp, Homo sapiens
  Payload ID: 3743
  Gene Symbol: CCDC67
  Gene Name: coiled-coil domain containing 67
  ENST ID: ENST00000530862
  CDS Start-End: 211-1871
ctcctcttagaagctattctcttctccctgaagggaggcaacactgtccgttcgcctgactggcagtgttttaaggacccatcgcgcttgacgggaaagtcagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactggtgagttgctggttgtgggctttttttttctttaatgggttattgctttactcttacactgatgtcaataaactgacgtacatagt

SEQ ID NO: 121113 - DNA, 2588 bp, Homo sapiens
  Payload ID: 3743
  Gene Symbol: CCDC67
  Gene Name: coiled-coil domain containing 67
  ENST ID: ENST00000534747
  CDS Start-End: 48-1094
cagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagaggtatgctggctccattatataagggcataactctgtattcctcactcacttttctttctttctctctttagtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattcaatggacttgaagcataaa

SEQ ID NO: 121114 - DNA, 767 bp, Homo sapiens
  Payload ID: 3743
  Gene Symbol: CCDC67
  Gene Name: coiled-coil domain containing 67
  ENST ID: ENST00000527307
  CDS Start-End: 39-359
aatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaagtaagaaaacttattataatttaatatcacacattttgatatatttttttttacctgtagagttgtgttaactttaaactgttttcagtataaacaaatgtcttgtattttaattataagcttggtcatgtctttccctgttttatatgcattgattttgtctcttactagattgttgtcttgctatattttctgtgcctctgttagcacagtagtagacaaatggctttctatttctcaagagacttgttgatgaattaaataataattagctcacaaaaaataattctgtgagcaacaacaaaaaacaattattttttgtggttattactatctaataaagatgttctcaattctgtgataatttaaaatgtggaagtttgctgttatgaaatagataattgaaataataaaactggtctttattacctt

SEQ ID NO: 121115 - DNA, 410 bp, Homo sapiens
  Payload ID: 3743
  Gene Symbol: CCDC67
  Gene Name: coiled-coil domain containing 67
  ENST ID: ENST00000530273
  CDS Start-End: 173-334
ggcccaggcggcgggagcgcggcggcgggtggcggggccccttggggcgggcctggcggggcgggaggtgacatacgcggtcctgcgccctcgcctcagacctctcgggcgagcgcggcgcagcgcagattaaaaatcaagaaatataaaccagatgtagcagtttcttgacatggagaaccaagcccataatacgatggggctgaagtgtaagacctcaataactacctgcttatccagtctgagtgactggacttacaccagctccctggagaatgcttcagcttctttgaaaaagaactctgtagtgagagcacttaccaatctgtcttaacaacagttgctatagtcctagctgttatactaagcattttgtttgaaactcaataaaccctcctggacccaagata

SEQ ID NO: 121116 - DNA, 1656 bp, Homo sapiens
  Payload ID: 3743
  Gene Symbol: CCDC67
  Gene Name: coiled-coil domain containing 67
  ENST ID: ENST00000531792
  CDS Start-End: 289-1626
agaagctattctcttctccctgaagggaggcaacactgtccgttcgcctgactggcagtgttttaaggacccatcgcgcttgacgggaaagtcaggtacaagctgatgctgttatcaccacaggaaccaggggctgagcggtgaaatccagctcctcccagctggaagacgctagggtgaacggagataaaagcagttctctttacccgaagtttatttctttttcatgccacttcaaatttggattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatggtaatatgctgacatcattcaataaattgaacaaagagatta

SEQ ID NO: 121117 - DNA, 1031 bp, Homo sapiens
  Payload ID: 3743
  Gene Symbol: CCDC67
  Gene Name: coiled-coil domain containing 67
  ENST ID: ENST00000532819
  CDS Start-End: 45-1031
attaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaa

SEQ ID NO: 121118 - DNA, 1920 bp, Homo sapiens
  Payload ID: 3743
  Gene Symbol: CCDC67
  Gene Name: coiled-coil domain containing 67
  ENST ID: ENST00000525646
  CDS Start-End: 129-1169
ggaaaatggggagtgactgttaatgagtatcaggtttcctttggggatgatgaaaatgctctggaataaagtagtggtgatgttcaactttgtgactaaattgaaaactgctggattgtacactttaaatgggcgaatttatggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattcaa

SEQ ID NO: 121119 - DNA, 2784 bp, Homo sapiens
  Payload ID: 3743
  Gene Symbol: CCDC67
  Gene Name: coiled-coil domain containing 67
  ENST ID: ENST00000531448
  CDS Start-End: 222-1730
gggagggagaggcccaactgcctcgttggtcgcgcggcgggagggcccaggcggcgggagcgcggcggcgggtggcggggccccttggggcgggcctggcggggcgggaggtgacatacgcggtcctgcgccctcgcctcagacctctcgggcgagcgcggcgcagcgcaggtaatgattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaaacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaacaaaatagacacatatgagcttttaaacttttttatttgcttcccccccccacccccgccaagaaaaaaagctctggcaaaatatttacaaagctgattaatgaaaccaagaaattctgttctgtttccttgagtaaataatttccgtaaggcagctagaaaatagtaagtattttgttctataaagctgttcacatttctgcattaacatgctaaattgtcctgctgtagagttactataaaataaacatgactattccaaaagagatttttttccagtctaaggaatattttggaatcaaatatgcagttttttttccccacttgaatcatgtatactgaaaacccatttcctcagcaactacacaaaataagagaaagggaagtgctatattccagatacaaatgactcaaaggcagctcagttgtactggttttgaaaactcaaggattttataaataaaaatatttaagtatttccagttatgtaaacactctaaaattctataattttttggaaaaaaaaagctatagctttattgtttttacattcacctttataatgtctgtctgtttcaacacaatgaaggtatatggaatgtgcaatttacaaacctaaaatatatgtgccaaaaattaacgcttttttgttagtactaattacttcatggacacaaacaagataaaggaaatataaagcattactgttgctacattttcctttgtaatcacttctgtttttaatacaataaaggaatgtaaaattcaatggacttgaagcataaa

SEQ ID NO: 121120 - DNA, 1964 bp, Homo sapiens
  Payload ID: 3743
  Gene Symbol: CCDC67
  Gene Name: coiled-coil domain containing 67
  ENST ID: ENST00000618031
  CDS Start-End: 167-1964
ttgagtttcgttccagcttctcctcttagaagctattctcttctccctgaagggaggcaacactgtccgttcgcctgactggcagtgttttaaggacccatcgcgcttgacgggaaagtcagattaaaaatcaagaaatataaaccagatgtagcagtttcttgacatggagaaccaagcccataatacgatgggaacttctccttgtgaggctgagcttcaggaattaatggaacaaattgacatcatggtaagcaacaagaaaatggattgggaaagaaagatgcgggctttggagacacgattagatcttcgggatcaagaattggcaaatgcacaaacttgtttggatcagaaaggtcaagaggtagggttacttcgacagaaattggacagtctggaaaaatgtaatttagcaatgactcagaattatgaaggacaactacaaagcctaaaggctcaattttccaaactaacaaataactttgaaaaactgagattacatcagatgaaacaaaacaaagttccacgaaaagaattaccacaccttaaagaagaaataccctttgaactgagcaatttgaaccagaaattagaggaatttagagcaaagtcaagagaatgggacaagcaagagatattatatcagactcatctgatttctttagatgctcaacaaaaattattatctgagaagtgtaatcagtttcagaaacaggcacaaagttaccaaactcaactaaatggtaaaaaacagtgcttagaagacagcagctctgaaattcctcgtttgatatgtgacccagatcccaattgtgaaatcaatgaaagagatgagttcattattgaaaaactgaaatcagctgtaaatgagatagcactaagcaggaataaattacaagatgaaaatcagaagctcttgcaagaactgaaaatgtaccaaagacagtgccaggccatggaagcaggtctctcagaggtaaaaagtgagttacagtcacgtgatgatctcttgagaattatagaaatggaacgattgcaattacacagagaattattaaaaataggagagtgccaaaatgctcaaggaaataaaacaagacttgaatcatcttatttgccttctattaaagaaccagaaaggaaaataaaagagctgttttcagtgatgcaagatcaaccaaatcatgaaaaagaattgaacaagataagaagccaactccaacaggtggaagagtaccataactctgagcaggaaagaatgaggaatgaaatctctgacctaacagaagagcttcatcagaaggagatcactatagcaactgtcacaaagaaagctgcccttctggaaaaacagttaaaaatggaattagaaataaaagaaaaaatgttagcaaaacaaaaggtctcagatatgaaatataaagctgtcagaactgaaaacacacatctaaaaggaatgatgggagatttagaccccggagaatacatgagtatggacttcactaacagggaacagtcaaggcatacatctattaataaactgcaatatgagaatgaaaggctccgaaatgatcttgcaaaacttcatgtcaatggaaaatcaacctggactaatcaaaacacctatgaagaaacaggaagatatgcctatcaaagccaaataaaagtggaacaaaatgaagagagacttagtcatgactgtgagccaaacagaagtacaatgcctcccttgccaccttcgacatttcaagccaaagaaatgacaagtcctttggttagtgatgatgatgtattcccactgtctcccccagatatgtccttcccagcatctttggctgcacagcatttccttctggaagaagagaaacgagcaaaagaacttgaaaaacttctaaatacacatattgatgaactgcaaagacacacagaatttactcttaataaatactccaagctaaaac

SEQ ID NO: 121121 - DNA, 1457 bp, Homo sapiens
  Payload ID: 3744
  Gene Symbol: CCDC68
  Gene Name: coiled-coil domain containing 68
  Uniprot ID: Q9H2F9
  ENST ID: ENST00000337363
  CDS Start-End: 173-1180
gttgctattttgtgaattactgataggcatgttatttgttagcttatttgtttacagtatgctcaacattgaagggaagccagtcttaatatgatggaaacatctctgaacttctaaaagaccaaggttggcgttttagctctattaattttacttcgtcttggaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctg

SEQ ID NO: 121122 - DNA, 4014 bp, Homo sapiens
  Payload ID: 3744
  Gene Symbol: CCDC68
  Gene Name: coiled-coil domain containing 68
  Uniprot ID: Q9H2F9
  ENST ID: ENST00000432185
  CDS Start-End: 160-1167
tttatgaatatatacagataccaatgatttatagcttttctgctatatttgactatagtgataaaacaacttatttcagtttatgaaccatataatcatacaatcaaaacagtctgttttgcttagctgatttatgttttcctaaagccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttacgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctgacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatg

SEQ ID NO: 121123 - DNA, 4132 bp, Homo sapiens
  Payload ID: 3744
  Gene Symbol: CCDC68
  Gene Name: coiled-coil domain containing 68
  Uniprot ID: Q9H2F9
  ENST ID: ENST00000591504
  CDS Start-End: 276-1283
ggggcctcaccggcgccggactctgccctgggcgcgccccgcggggcggagccaagcctgcgggcggtggcggctgcactcgcagggccctggcagccgaccctggccccaaggtccgatcgcccaggggaggagcagcaccgggaccccgcgtcggctgggcgccccacaagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaaaatcaaacaaatctatatttaatggatggactcttcaaaacttaccaaatagttgaagaaaccaggtgccttctcatgatggaagacagattctgctttaaattaaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttacgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctgacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatgaa

SEQ ID NO: 121124 - DNA, 708 bp, Homo sapiens
  Payload ID: 3744
  Gene Symbol: CCDC68
  Gene Name: coiled-coil domain containing 68
  ENST ID: ENST00000592040
  CDS Start-End: 1-610
attatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtggagtttgtgattgcagtgaatagaacaaattctgacttgcagaaatgcagacatacagtc

SEQ ID NO: 121125 - DNA, 3451 bp, Homo sapiens
  Payload ID: 3745
  Gene Symbol: CCDC69
  Gene Name: coiled-coil domain containing 69
  Uniprot ID: A6NI79
  ENST ID: ENST00000355417
  CDS Start-End: 176-1066
atttacggcgggcggccgccccagctcaggctcaagacagcgcttccaggttcagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtgaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcacctta

SEQ ID NO: 121126 - DNA, 479 bp, Homo sapiens
  Payload ID: 3745
  Gene Symbol: CCDC69
  Gene Name: coiled-coil domain containing 69
  ENST ID: ENST00000522964
  CDS Start-End: 1-267
aagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacaggcggctgatcctcatggaaacagtg

SEQ ID NO: 121127 - DNA, 291 bp, Homo sapiens
  Payload ID: 3745
  Gene Symbol: CCDC69
  Gene Name: coiled-coil domain containing 69
  ENST ID: ENST00000519740
  CDS Start-End: 123-266
agtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaaggcaatcccgccctctcttttacaaccacccttacactgtctgctgaagaacaggggatggtgtggagggctccaggttctcacccaggcctcctgagcaagggaccctcctttcctgctct

SEQ ID NO: 121128 - DNA, 2864 bp, Homo sapiens
  Payload ID: 3745
  Gene Symbol: CCDC69
  Gene Name: coiled-coil domain containing 69
  ENST ID: ENST00000518189
  CDS Start-End: 1-560
agaagcgccaagaaccagaaccagaacagccacccagaccagagccccatgaattaggtcccctcaatggggacacagctataactgtccagctctgtgcatcagaggaggctgagcggcaccagaaggatataaccagaattctccagcaacatgaggaggaaaagaagaaatgggcacaacaggtggagaaggaaagggagctagagcttcgagacagactggatgagcagcaaagggtcctggaaggaaagaatgaagaggccctgcaagtcctccgggcctcatatgaacaggagaaagaagcgcttacccactctttccgggaggccagttctacccagcaggagaccatagacagactgacctcacagctggaggctttccaggccaaaatgaagagggtggaggagtccattctgagccgaaactataagaaacatatccaggattatgggagccccagccagttctgggagcaggagctggagagcttacactttgtcatcgagatgaagaatgagcgtattcatgagctggacagaaagagaaaaatctgatattggaggaaaaaattacgaccctgcaacaggaaaatgaggacctccatgtccgaagccgcaaccaggtggtcctgtcaaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaa

SEQ ID NO: 121129 - DNA, 1899 bp, Homo sapiens
  Payload ID: 3746
  Gene Symbol: CCDC7
  Gene Name: coiled-coil domain containing 7
  Uniprot ID: Q96M83
  ENST ID: ENST00000277657
  CDS Start-End: 310-1770
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaa

SEQ ID NO: 121130 - DNA, 1994 bp, Homo sapiens
  Payload ID: 3746
  Gene Symbol: CCDC7
  Gene Name: coiled-coil domain containing 7
  ENST ID: ENST00000302316
  CDS Start-End: 1-1942
attgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcttgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaataattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaattaaaaatgaagcagcctcagaacttccagatacagcagaaaatcttccagcaatgtacccgtcaattagcgacctaataattcaatttgatttaaacaaagtggtcgagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataaggaacacttagcagatgatactggaagaggtataataaagggatcaatcaatgcacaactaaagggtcaccaaaagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgca

SEQ ID NO: 121131 - DNA, 2133 bp, Homo sapiens
  Payload ID: 3746
  Gene Symbol: CCDC7
  Gene Name: coiled-coil domain containing 7
  Uniprot ID: Q96M83
  ENST ID: ENST00000362006
  CDS Start-End: 544-2004
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaa

SEQ ID NO: 121132 - DNA, 2729 bp, Homo sapiens
  Payload ID: 3746
  Gene Symbol: CCDC7
  Gene Name: coiled-coil domain containing 7
  Uniprot ID: Q9H943
  ENST ID: ENST00000375025
  CDS Start-End: 474-2360
acttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcttgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctgcatgttttgaaa

SEQ ID NO: 121133 - DNA, 2129 bp, Homo sapiens
  Payload ID: 3746
  Gene Symbol: CCDC7
  Gene Name: coiled-coil domain containing 7
  ENST ID: ENST00000375028
  CDS Start-End: 71-1969
tggtttcagattcaggtggacaaaggacaagtgataaaatccaagaatatccacaggcagtacaagaaacatggtgccggcatctgcttctggcgagggcctcagggagcttctactcgtgcaggaaggtgaagtgggagcagatatgtcacacgctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataaggaacacttagcagatgatactggaagaggtataataaagggatcaatcaatgcacaactaaagggtcaccaaaagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggccca

SEQ ID NO: 121134 - DNA, 2542 bp, Homo sapiens
  Payload ID: 3746
  Gene Symbol: CCDC7
  Gene Name: coiled-coil domain containing 7
  ENST ID: ENST00000375030
  CDS Start-End: 619-2382
tggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatgctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagaattccctttatcggacgtgaaggacctcttcaaggagaactacaaaccactgctcaatgaaataaaagaggatacaaagaaatggaagaacattccatgctcatgggaaggaagaatcaatatcgtgaaaatggccatactgcccaagctcataatgaagtaccaaatgaaaggcttgtagttgagcatcaagaatcattgtcaaaaaccaaattacaaataaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcttgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaattaaaaatgaagcagcctcagaacttccagatacagcagaaaatcttccagcaatgtacccgtcaattagcgacctaataattcaatttgatttaaacaaagtggtcgagactgtcttaaaacacttgaaaggtgttaatggaaaagatataataaagcatctaatcaacatacagtcaaagagtcatggagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggccca

SEQ ID NO: 121135 - DNA, 482 bp, Homo sapiens
  Payload ID: 3746
  Gene Symbol: CCDC7
  Gene Name: coiled-coil domain containing 7
  ENST ID: ENST00000435402
  CDS Start-End: 1-482
aaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatgctaatagagtttctgaaatactttggaaaagtctcccaaaccttcagagagtg

SEQ ID NO: 121136 - DNA, 1819 bp, Homo sapiens
  Payload ID: 3746
  Gene Symbol: CCDC7
  Gene Name: coiled-coil domain containing 7
  Uniprot ID: Q96M83
  ENST ID: ENST00000476558
  CDS Start-End: 310-1113
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctcttt

SEQ ID NO: 121137 - DNA, 3998 bp, Homo sapiens
  Payload ID: 3746
  Gene Symbol: CCDC7
  Gene Name: coiled-coil domain containing 7
  ENST ID: ENST00000545067
  CDS Start-End: 297-812
agtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaggataaagaaaatcgaccagaagcagtgaaaagttgtgaagctctggcacagaaaattgaagaattcttagaagcccactcaactgatgaatttaaagatgtttctgcaacagaaccacgattaactccttgggttgccaaataaacccaaaacattgaatttaatgtgtatgcagaaaccaaatccacttttgcttgttcaagtggatccaacttctgcaacaactcatttctagaaacagacatcgtggtcttcagcatctcatccacagcaccaatggaattctcaaacgctgacaaatactcgtgaatttctactggatagtcttcattaatttcttcacctgccgttatggctgactcacggccttcgactccagcctcccggaaagcggtcgggcaacgatgacgacaatgacgcgccagctctgcccgcgccaccagcggcgctttccgatgatctcaccaatgtatagctttttatacacaaattacataccaataaagtgatttaaaagtataggataaaatatagaaactaggattttattaaattattatgcataaatttatatagtagcaggataggacaatcatgttggtctttgggggagctaatagacatattcttcaggatcttgtcagtgcattgtctagctgttcacctgtgcatattgagaaataaataaataggcatagatctagagggccttgaaattcttttgtaattgtgggacaaattgagatctcaattagatattgatttgttggatggtttgtgaagatatgattcctttttggtgaacagaatgcttagaactagtgttcagtcttagagatgaagttgttaagttagataagaacaatgtacattacctgaatcatgtggtctggacaggaaagcagtcctgttaagaattccttcatgacatttttctagggaggcatagatgttacaagtgaaggtaataggctgttttgcctttcaaagcgtctttagcccaagtgcatgcatcacaaatagtcaccttatgtcagaattggaatcataataattctaacatggcaaattcacattcgtgaatgaatttcagtgattagctagggcataggcaaggcaaaggcatccatgtggttaaaaagtaatgacagattctgaattcacatcatttaaaaaagtaacattgattacagacctaaatgtaagaaaataaaaccataaaaagggagggaattcaactcccaaaactgaaaacacctcgttcaaaattgaagcaaagttacaaggtaagcagtagactgggagaaaagatttgtgctcatacagtagaaaaaaggagtactaataagaatctataactccctaaaaacacataagaaaaataggcaaagtatataaagaggaggtaactaagggaaagacaaaaaaattggccaataaacattttaagagatgctcaatctcaccgtgatcagggaagatataagacaaagccatgacttttttgtctacaaaatttagaagttttctaatatcaactattggcagagaggtagtggaatgaatactcttaccatgctaatataatagaaatttccccctttcgaggacaatttagcacagtttagtaataacaaaagtgtatgccatgttatatagcaaatctctttttatctaccctcgggaaaggagtacaatgtgctcaagaaagcatataaaaggaattttttttgcatcagtgcgatggtagcagaactagaaagaacctgtttttgttagtaggagtatggctcaataatctatggtaaatggataataagggaatactatgaataactatgtgaccacaaattagataacttagatgatatatatctctagaaaaacccaaactaaactgtatcaagaagaacaagaacatgtgactgaacttataagtagtaaaagatttaattagtaattaacatattcccaccaagaaatgcttaggccagatgacttcactttttaatcctgtcaaatatttaaagaagagttaataccaggcctgtacaaactcttctaaaaaattaaagagttcacacttctcaattcattctatgagattagtgttactctgataccaaaattagacaatcacaagaacataaatatgatatttattttaagaagataaatatatgttatgaatatgaacatgaaaatccttaccaaaatactagcaaactgaatccaacagcatataaaaaagattatctatgatgaacatgtgagatttattttaggaatgcaaggttgatttaaaatgcaggtatcaatttacataatgtgtaatattgattaaataaaggagaaaaaattacatcagttcgctagattcagtaaatgcacttgacaaaattcaacatctttttatgatacaaagttccacaaaccaggaatagaaggaaacttccttaacctgatgaaggccatctacaaaccccatggtcaacatcatactcagtggtgagaatgaataatttctccctatgatcaggaacaagacaagacattcacttctattcatcattatagtggaggttctagcaagggcaattatggaagaaaaggaaataaaagtgtctgcattggtgaggaagaagtaaaactacctctatttgcaaatgacatgattttagatataaaaacatcctgagttctgctaaaacctattggaagtaatgaatgaattcatcaaggctgcaatatacatgatcaataaacaaaaacaatttgtatttctatacactagctgttatgggttgaattgtatcccctcaaaagatatgttgaagttctcaccccctgctacctcagggtgaccttatttggaaacagggttattcccgatattattagttgagatgaggtcatactggagtaggatgggcccttaatccaacgtgactaatgtccttataggaattggaaaagacagataaacatggaggaaatactgctaatgtaaagatagagacagagactggatttattctgccacaatccaaagaatgccagggactaacagtggctagaataggcatggtggtttccttccccagatatttcagagggagcatggctgtgccaacactttaattttggatttcaagtcatcaggctgtgagaaaataaattcttgttgtttt

SEQ ID NO: 121138 - DNA, 657 bp, Homo sapiens
  Payload ID: 3746
  Gene Symbol: CCDC7
  Gene Name: coiled-coil domain containing 7
  ENST ID: ENST00000537047
  CDS Start-End: 23-550
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaaaactgctcattcaatgactaatcgatttaatgccatgttgaaagtatttgaaaaccaggcaaatatgttggagagagctgtaaatgatcaagttttgttagatgctgaatacaaacagatgcag

SEQ ID NO: 121139 - DNA, 581 bp, Homo sapiens
  Payload ID: 3746
  Gene Symbol: CCDC7
  Gene Name: coiled-coil domain containing 7
  ENST ID: ENST00000539197
  CDS Start-End: 23-544
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaagctgtaaatgatcaagttttgttagatgctgaatacaaacagatgcag

SEQ ID NO: 121140 - DNA, 700 bp, Homo sapiens
  Payload ID: 3746
  Gene Symbol: CCDC7
  Gene Name: coiled-coil domain containing 7
  ENST ID: ENST00000535327
  CDS Start-End: 23-538
tggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaggataaagaaaatcgaccagaagcagtgaaaagttgtgaagctctggcacagaaaattgaagaattcttagaagcccactcaactgatgaatttaaagatgtttctgcaacagaaccacagctgtaaatgatcaagttttgttagatgctgaatacaaacagatgcag

SEQ ID NO: 121141 - DNA, 1858 bp, Homo sapiens
  Payload ID: 3746
  Gene Symbol: CCDC7
  Gene Name: coiled-coil domain containing 7
  ENST ID: ENST00000623087
  CDS Start-End: 1-1500
aggcgtaatactcgtattgtagtaccaaatgaaaatgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaacgaagaaacttcaagctaaagtaacttcaagaaaaattaaaaatgaagcagcctcagaacttccagatacagcagaaaatcttccagcaatgtacccgtcaattagcgacctaataattcaatttgatttaaacaaagtggtcgagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatggagagactgataaggaacacttagcagatgatactggaagaggtataataaagggatcaatcaatgcacaactaaagggtcaccaaaagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacagttggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctgc

SEQ ID NO: 121142 - DNA, 1150 bp, Homo sapiens
  Payload ID: 3747
  Gene Symbol: CCDC70
  Gene Name: coiled-coil domain containing 70
  Uniprot ID: Q6NSX1
  ENST ID: ENST00000242819
  CDS Start-End: 297-998
aagtcaaagattgaagaggaactctttcaaacctttcaagtgccccctcctttccttaaagtcttttataggggtccccttcttggccatctccatcctgtgagtcaggactgaaagggcacagacaggtcactgccagcattgttggggcaagcctgcaagcacgcatcactggggatctgacatgacaatggccgcctgccccctctgagggctacaggacttaccccagtgggaagcagctaagcaggtctgaccagccgacctggacctggccaagggtcctgtcatccctcatggccaccccgccattccggctgataaggaagatgttttccttcaaggtgagcagatggatggggcttgcctgcttccggtccctggcggcatcctctcccagtattcgccagaagaaactaatgcacaagctgcaggaggaaaaggcttttcgcgaagagatgaaaatttttcgtgaaaaaatagaggacttcagggaagagatgtggactttccgaggcaagatccatgctttccggggccagatcctgggtttttgggaagaggagagacctttctgggaagaggagaaaaccttctggaaagaggaaaaatccttctgggaaatggaaaagtctttcagggaggaagagaaaactttctggaaaaagtaccgcactttctggaaggaggataaggccttctggaaagaggacaatgccttatgggaaagagaccggaaccttcttcaggaggacaaggccctgtgggaggaagaaaaggccctgtgggtagaggaaagagccctccttgagggggagaaagccctgtgggaagataaaacgtccctctgggaggaagagaatgccctctgggaggaagagagggccttctggatggagaacaatggccacattgccggagagcagatgctcgaagatgggccccacaacgccaacagagggcagcgcttgctggccttctcccgaggcagggcgtagccagcatgcaggtgcagggccctgtggtccagactcccctgggttgggattcaagtccagggtgagcccatgtgctggagaaaatacacactcattggtctccttgctttgaaagatccaataaagtcctgaggcaaggtttggaaaaccaa

SEQ ID NO: 121143 - DNA, 1781 bp, Homo sapiens
  Payload ID: 3748
  Gene Symbol: CCDC71
  Gene Name: coiled-coil domain containing 71
  Uniprot ID: Q8IV32
  ENST ID: ENST00000321895
  CDS Start-End: 108-1511
gttggagcagcggaggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttcca

SEQ ID NO: 121144 - DNA, 4232 bp, Homo sapiens
  Payload ID: 3749
  Gene Symbol: CCDC71L
  Gene Name: coiled-coil domain containing 71-like
  Uniprot ID: Q8N9Z2
  ENST ID: ENST00000523505
  CDS Start-End: 101-808
gagacgccagcagcagccgccgccgcggagccaacgcggactgggacggcggcggcagtagtgggacccggcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaaccatatggtgtgtgattaaaaaaaatgaataaattgtgaagaactggttttggttacaggagtcactggaatccgactggagatgatttggccccctgtcctggtctaacatacaaatctaggaatattatgcgttaaagtattttaaaatacattatccttgtaatgtattttacaaggataatgtattttaaaatgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcacctcgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttttaatggacatacatgcctaatatttattggtgtgtttaaaatattttttgatagagtgttatgtcttaagcgcattagaaaacaattgtttgtaatggaatcaaagtgtttccctggacagtttgatgtgcttatggttgagatttataatctgcttgtactttgctttttaacttattaactgtaaataaattttagagaatacata

SEQ ID NO: 121145 - DNA, 1575 bp, Homo sapiens
  Payload ID: 3749
  Gene Symbol: CCDC71L
  Gene Name: coiled-coil domain containing 71-like
  ENST ID: ENST00000315965
  CDS Start-End: 43-993
gcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcgccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaaccatatggtgtgtgattaaaaaaaatgaataaattgtgaagaactgg

SEQ ID NO: 121146 - DNA, 3849 bp, Homo sapiens
  Payload ID: 3750
  Gene Symbol: CCDC73
  Gene Name: coiled-coil domain containing 73
  Uniprot ID: Q6ZRK6
  ENST ID: ENST00000335185
  CDS Start-End: 45-3284
aacaggagctagaggcgcgcttcgctgaggaaataaatattaatatggaaagcaacttcaatactgagtcatcatctacttttactcttcaaagttcttcagagacattgttttctattcagctattagatttcaaaacaagtttactggaggcattagaagaattgcgtatgagaagggaagcagaaattcattatgaagagcagattggtaaaattattgtggagacacaggaacttaaatggcaaaaggaaactcttcagaatcaaaaggaaacattggcagagcaacacaaggaagcaatggcagtttttaaaaagcagttgcagatgaagatgtgtgccctggaagaagaaaagggaaaatatcaacttgctacagaaataaaggaaaaagaaatagaaggattgaaggaaacattaaaagcactacaggtttctaaatactctttacagaagaaagtgagtgaaatggaacaaaaggtccagttacatcttctggctaaagaagactatcataagcaactgagtgaaattgagaaatattatgccacaataacaggtcaatttggattggtaaaagagaatcatgaaaagttagaacaaaatgtacgggaagcaatacaatcaaacaaaagactttcagctttaaataaaaaacaagaagctgaaatatgcagtttaaagaaggaactaaaaaaagcagcctcagacttgataaagtccaaagtcacatgtcaatataagatgggagaagaaaacatcaatctaacaattaaagaacaaaaatttcaagaacttcaagaaagactcaacatggaattggaattaaatgagaagattaatgaagagattacccatattcaagaagaaaaacaggatatcatcatttctttccaacatatgcagcagttacttcggcaacaaattcaagctaatactgaaatggaggcagaattgaaggtgctaaaagaaaataatcagacccttgaaagagataatgagctgcaaagggagaaggtaaaagaaaatgaagaaaagtttcttaatcttcaaaatgagcatgaaaaagcactaggaacttggaaaagacatgctgaagaacttaatggagaaattaataagattaaaaatgaattatcatcccttaaagaaactcatattaagttacaagaacattataacaaattatgcaatcaaaaaacatttgaggaagacaaaaagtttcagaatgttccagaagtaaataatgaaaacagtgaaatgtcaactgaaaaatcagaaaacaccattatacagaaatataatactgagcaagaaataagggaagaaaatatggagaatttttgttcagatactgaatacagagaaaaagaagaaaaaaaagaaggctcatttatagaggaaataattatagatgatttacagctttttgaaaaaagcttcaagaatgaaattgatactgttgtttctcaggatgaaaatcaaagtgaaatctccttaagcaaaaccctctccttagataaagaagtaattagtcaaggacaaacctcgaatgttacggacaacagaaaatcagttactacagaaataaaagacaagatatgcttggaaaaagacaatggatgtacagaatttaaatcaccaaataatcattttgtagtgttagatacagcaatagaaacagaaaaaatacatctagaaagaaccagaggattagatgttcaccatacagatgtaaatctggaggttgaaaataacaaaacatcatttaacagtattttaaatgagacagcacacaatacatatcacaataataataaagatgtttctgaaaatgagccattcaaacaattcagattgcttccagggactcgagaacatgctctagagaaggaaattacaaatagtgaccaaaccaaagcagatttggactcgtctctagatataaaaaaaaatcctgttccatgtcagaaatatagtttacggaattcaagtaatgttatgttagatgataaacaatgtaaaataaaacaaatacaactgttaactaaaaaaagtgagtgcagcatattactttctaaacaaacttcagattttctgcaagtctgtaatgatactttagagaaatctgaactaactgttccctgtgatatagtaatcgaccaccatgtttcatatgctgcttttagtgctaattcaaaactacttctgaagaactcagataaaaatgtccatagtatgtctatgttggtgaaacctaactcaagccctgggggaaaaactatgtgtaaaaatatgagtgatatgcaaaacagtcaatttaataactgtttgggatacttagaaaacactaatgtgaacatttcccatcttcatcttaacaatgagaatagtcatgcttcacaagccaaagatgtgaaaactgctgttcacatgaaaacttgcacagaaacagagttttccaataaaaagaatcagattgatgagaatcaggtaactgaagccacaaaaaatgacctcttcctttttgtgagcattaatgaaagacagcatacattgttaaataatacagagaaaacagaatcattaaatgacattgtttcaggaaaaatgttcagtgaaggacagctggaggaatcacattcatttcacatagagccatctggagatttagtaaacagaagcggaaggtcaacctttgatctttcaacttcagataaaaaaactgagaaaactccagtatacatgaatttttcagaccccggtccttggtcaaaagtaaatcacattgaaagtcaaacagcgagcagttcgaccccttgcatttctttgttgctgaaggagagaccactagatccatcagaaaacaaaaagatcatttcaatggctctttgtaaaaatattggtgtggatgatgttggaaaggatattggaccagatactaccagcattaacagagttgctgacactttgaataactggagtatccatccagatcccaagggagaacccagtgaagagaagaatgcaatggcaaagactttttatgattcctcttttcccacagaacatgtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattatgtaactgaaattctggtatagtttttactagaataaaatgactgttgtatttaaagctctacagtttgtctttgcttttccaagtttttctaatgtgaagaaattgtattactctacttctgtcttctctctgtatattatcctttctttaaagtgctcattgcttcttcaatatccttttttaaagaacagaatttatgtattgtatgacagacattgtgaccccttgtaatttattacttcatatcctctggagtttgtgattttagtataaatttgagacaataactgtccagactaggcaaatttttttagtttataatgttttactatgatttagggcttttttttcaaagaacaaaaattataagcataaaaactcaggtatcagaaagactcaaaaggctgtttttcactttgttcagattttgtttccaggcattaagtgtgtcatacagttgttgccactgctgttttccaaatgtccgatgtgtgctatgactaaaaattgaaaaattaaacacagtgttagtc

SEQ ID NO: 121147 - DNA, 433 bp, Homo sapiens
  Payload ID: 3750
  Gene Symbol: CCDC73
  Gene Name: coiled-coil domain containing 73
  ENST ID: ENST00000528333
  CDS Start-End: 1-347
aggctgaagaacttaatggagaaattaataagattaaaaatgaattatcatcccttaaagaaactcatattaagttacaagaacattataacaaattatgcaatcaaaaaacatttgaggaagacaaaaagtttcaggtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattatgtaactgaaattctggtatagtttttactagaataaaatgactgttgtatttaaa

SEQ ID NO: 121148 - DNA, 4381 bp, Homo sapiens
  Payload ID: 3750
  Gene Symbol: CCDC73
  Gene Name: coiled-coil domain containing 73
  ENST ID: ENST00000531481
  CDS Start-End: 278-754
aagtcggagcagtcacaagcgtgtagttgggctgtttaggaagcagccctaatcttttcatgcagggtccacttacgggtttgccctgcacctccagctgcgtaacctacccttccttgctctggttgccaaggggctgctttggcctggagcctcctgactgctgggctgtgtctagaatcttccacgctcccgacccaggagaagcagccacactgaggcatccatctggatctctgcttgggcaggattgagactgcgggaaataaatattaatatggaaagcaacttcaatactgagtcatcatctacttttactcttcaaagttcttcagagacattgttttctattcagctattagatttcaaaacaagtttactggaggcattagaagaattgcgtatgagaagggaagcagaaattcattatgaagagcagattggtaaaattattgtggagacacaggaacttaaatggcaaaaggaaactcttcagaatcaaaaggaaacattggcagagcaacacaaggaagcaatggcagtttttaaaaagcagttgcagatgaagatgtgtgccctggaagaagaaaagggaaaatatcaacttgctacagaaataaaggaaaaagaaatagaaggattgaaggaaacattaaaagcactacaggtttctaaatactctttacagaagaaagtgagtgaaatggtaaggaaattacaaaacatattttcccccatctggattagtacttagggggattggtgtttttgggaataaaatgtgacatttatagtgaaaaaattaattgttgaaactgaatattactgtctccagtaatatgaaaggggatatttgcaatttcacatgttgcataaatgaattatttcacaaatttatttcgagattacatagtacttatacaggttgagcatcccaaatctgaaaactcaaaatttgaaatgcttcaaaattggaaactttttgagtgtcaacatgatgctctaagaaaatgctcattggagtattttggactttagatttttgcatttgagatgcttaacccgtaggtataatgcaaatattccaaaatcccaaaatatcccaaatatgaaacacttctggtcccagcatttctgattagagatattcaacctatatgtttaaaataaattttacacagttcccaaattattgttagggtcttatagtaaaaacaaataacaaaactctaaaacctcttattttaatggtatcttttctagatatttatgtaaacatgtaattattaattatagtgtgaaaaaattgaaatgtatgaagtagtatttaggatataatatttatcccttatcagtgtacacttgggatatggtactgatcctatattgttcaacaaatatttatttactgtgcattcctcttttatagtctgttaaaaactaatgtttttgctttttacagcataacattttagggaatatttactttgatatttttcccttctagctctattttattcagaaggatttttttttctgtgtttttggttgagcaaaattttcctatatccactcaaattgtcaaagggctttttgggtggggctatgctattcagtcttcattctttggagcagactgtaaagcaagtaaaattaatttttgagtaaggcttatatattatatacatgagaagtaagaaatgaactatcaccccttctgacattacatagaaaaacataaagtattttgcttcttgaaattgtttggtgtgttagaaaataagagtcatagactgctaagcttgattgaataaaagatgtgaaaattctgttgctattcaactggaaagaataaaaataatattgtcagactattttaaaccatgattttaattaagaagctgaaaaactagattctggtttagctttaagtaccatgacatttgtactgaaagtcatcttcaacgctacagtggttttacacaaaatatagtgaaattgaataatgtgccctttgacctgggagataaggctacaagttaaagatcaaaggcaacataaaatgtgttttattttattccactttcaaatttcatcaaacagatacttacaatctttaaaaaaaaacatggaaacatgtatatacttattctagtttttggtcacttctaagctttttgttattgtgaattacaacatttatacttactaaaatgatatttcagttatagtcataatattttttctgacagtttaaagcattgcatcacttttaatttaaaaagttttatatgttggtatatatatttaatattttatattcattctggcagaacatttatattttggatttaaaagttagaagtacccctttttctaagcattcttacttatattcattttacattattcctgttacattattattatataattcagatgacttgttctttattcaaagtgcggtatagtattcagtaattcagttaatcttattttattccaagcagtacattattcttttatgttatttggttctatgggcaagacaggaaacaagatagccactagtgtgaaggcacgactttggggagcaataaagttagggtcctaaaagaaataacttgaaaaatactattaagaaaatttcaagtttatgagctcctataggtaagtccttaactactagtaagtttctgtcttctgtgattcagtaagctgattttcttttagaggtggtgataggttctgagataaattaacataatcacaaatcaaacgatttttccatccctaaaagtacctcccctttgaaaaaatcacgatcattaccaattaaaaggatgcaataaaaacatgtgagagagaaatcttaggacattacattcaccatcattgtgatctggtcattgatacaaatttttcctgctgtgtttagtgattactacatagatgaccatgttgggtaataattgaatttatcggtgtctgtgttgtaaaactgaatagctaatatagcttaatgaaggaagtaaacttatcaaaccattgtcgtattgtttttctcttctgtatatcattttcctctaaataaaagatttacaagaaagcctttttctttatgaagttaaagcaatttcaatattgaaagttttgatagattaagaataaccacatactttctttcccagtagaatatttttaaactgaagacttatctggaagtaacttcataatcataaatattatgtatatatgtacacacatatattagcagcatgactttaggtttttaaagtaatctatgcctcatatttgcaactgaaaaggtaaggatatcttaagaaagatgccatagatttttgaaaattgagttttataactccattgatttagtttgggttcatattgaagaaattagaagattagttacaaaattgtaaatgagtgtgttaaatttatattttgattgttatcttttcctctaaagtttactcttaacaaactgattgttttaagggaaactaattttatctccagaagttttcaaatcagtctccttaagtaaataggaaaagggagaaatgtgaagctgtgcattttatcagtaaatatatttctaaaaagttgtgtgtaaatatttttacattattcccattttaaatgcttcaaggctttaaagtaagcttttagactacacacatacatataattatggatatgctatttttccgctaatcttgactttcatagattagatttgtttaaaatgaggtgtacatgtgtttaggaagcaatgaatgctgacattttttgtagactgtgtttgcatttgatagtaaaactacgtaaaagaaaaaataatttgagtcgattcatgcagatagaaaaaccaaacaatatgtacttaactatttcttaatcatctcaataaaatagccttataatacattaaagttttaatagtaaaaatcaatttatttgtattctttaaaatattcttacatctctaaagtgttattaccacttactttttgttgttgcttttcagagaatttaaaccatttgttgatagtcatgaaattagtggcaaactggacaatggacctcttcatctcattttcaaaactaaatcagggtagtaaactacgttcatataggcatatatgggctaatatgctgtaggtgcctatgtgatttagaagtcttaatgttatatatcatggccattgaataggctaatgtgtttgaaaatcagaattatgtcatgcaaacaaatgcaatgaaactgcattttcattaaattcaatttttgccccaaagaatgttggaagagtgtatcagaaattactctaatgtatataaagctctatgcatgaaa

SEQ ID NO: 121149 - DNA, 1543 bp, Homo sapiens
  Payload ID: 3751
  Gene Symbol: CCDC74A
  Gene Name: coiled-coil domain containing 74A
  Uniprot ID: Q96AQ1
  ENST ID: ENST00000295171
  CDS Start-End: 139-1275
cagcgacaggccccgcccccgccaaccgcctcgcgccttccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 121150 - DNA, 1298 bp, Homo sapiens
  Payload ID: 3751
  Gene Symbol: CCDC74A
  Gene Name: coiled-coil domain containing 74A
  Uniprot ID: Q96AQ1
  ENST ID: ENST00000409856
  CDS Start-End: 92-1030
cggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 121151 - DNA, 930 bp, Homo sapiens
  Payload ID: 3751
  Gene Symbol: CCDC74A
  Gene Name: coiled-coil domain containing 74A
  ENST ID: ENST00000454549
  CDS Start-End: 116-523
aaccgcctcgcgccttccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgggtcagacacacctctgttaaaaactttatagaggggcccgggcgcggcggctcacgcctgtaattccagcactttgggaggccgagacgggcggatcacgaggtcaggagatcgagaccatcctggctaacacgatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggtgagcaggc

SEQ ID NO: 121152 - DNA, 851 bp, Homo sapiens
  Payload ID: 3751
  Gene Symbol: CCDC74A
  Gene Name: coiled-coil domain containing 74A
  ENST ID: ENST00000434330
  CDS Start-End: 232-851
ctgagtgccgagtatcccatcaccaggcgtctgttttgtcaggaccccgcttccccatgtcttcttgagcctcaggacgcccagttcctaatgtcttcttgagcctcccccgcagtccctgatccccacgggatcatgacactgccatagccaggggttccggagttcacctctgtacccctaaagcccaggccctgcctgggcagtgtggatgccctccagtcatctcagatggatgaggccgatatgcccggtgggctctgcctagggaacaggcagggccattcctggcctgacacccacgacgaaggcgtggtggagagcgggatccatggggcagggcccaatcagccagtgggggggcaggacttttgggctcagcagccaggagaggacaggccaggcttcttctctcagaatagctgtggtttcacaagtgctgaggagagcgtgtgcttgctttcagatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccaggtga

SEQ ID NO: 121153 - DNA, 1347 bp, Homo sapiens
  Payload ID: 3751
  Gene Symbol: CCDC74A
  Gene Name: coiled-coil domain containing 74A
  ENST ID: ENST00000467992
  CDS Start-End: 138-956
agcgacaggccccgcccccgccaaccgcctcgcgccttccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttcc

SEQ ID NO: 121154 - DNA, 1549 bp, Homo sapiens
  Payload ID: 3752
  Gene Symbol: CCDC74B
  Gene Name: coiled-coil domain containing 74B
  Uniprot ID: Q96LY2
  ENST ID: ENST00000310463
  CDS Start-End: 139-1281
cagcgacaggccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 121155 - DNA, 1353 bp, Homo sapiens
  Payload ID: 3752
  Gene Symbol: CCDC74B
  Gene Name: coiled-coil domain containing 74B
  ENST ID: ENST00000392984
  CDS Start-End: 138-962
agcgacaggccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttcc

SEQ ID NO: 121156 - DNA, 1296 bp, Homo sapiens
  Payload ID: 3752
  Gene Symbol: CCDC74B
  Gene Name: coiled-coil domain containing 74B
  Uniprot ID: Q96LY2
  ENST ID: ENST00000409943
  CDS Start-End: 84-1028
atggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 121157 - DNA, 871 bp, Homo sapiens
  Payload ID: 3752
  Gene Symbol: CCDC74B
  Gene Name: coiled-coil domain containing 74B
  ENST ID: ENST00000409234
  CDS Start-End: 88-765
ttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaaggtgagaactgggcccttcagttcctgatgggatgctcttgccacccaggggagcccctccagactgtccttgcccacctggctgcactggcccctgtatgccaacccagtggggacaggttctgggggacctggacagatgccgctacctctagccgtggctggatgatgttacgcagccaagcacagcacgtgctgctctcaggaagcccagggcctgaggtcattgcagtggggaggtgggcacagggtgctccccagacctccctcctccaagtagagctgaaatgggaaggaacccctgggacagcccctgccctgctagatctttgcctcagattgctgctgtggccaggcccaggatctccagccctatggctctgagtcctgacatgctgggggcccaggggctctggacacactccatccagggatcccttcctgccatctgggcagcaaccatggggacaaagggaggaagcagagtcct

SEQ ID NO: 121158 - DNA, 789 bp, Homo sapiens
  Payload ID: 3752
  Gene Symbol: CCDC74B
  Gene Name: coiled-coil domain containing 74B
  ENST ID: ENST00000409128
  CDS Start-End: 38-652
gtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccgttacaagctcataatgaatcagacatcacagaagaaagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctcc

SEQ ID NO: 121159 - DNA, 561 bp, Homo sapiens
  Payload ID: 3752
  Gene Symbol: CCDC74B
  Gene Name: coiled-coil domain containing 74B
  ENST ID: ENST00000441670
  CDS Start-End: 83-561
tggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccgttacaagctcataatgaatcagacatcacagaagaaaggtgagaactgggcccttcagttcctgatgggatgctcttgccacccaggggagcccct

SEQ ID NO: 121160 - DNA, 613 bp, Homo sapiens
  Payload ID: 3752
  Gene Symbol: CCDC74B
  Gene Name: coiled-coil domain containing 74B
  ENST ID: ENST00000457413
  CDS Start-End: 1-613
gagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcct

SEQ ID NO: 121161 - DNA, 806 bp, Homo sapiens
  Payload ID: 3752
  Gene Symbol: CCDC74B
  Gene Name: coiled-coil domain containing 74B
  ENST ID: ENST00000434929
  CDS Start-End: 21-302
gagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggggtcagacacacctctgttaaaaactttatagaggggcccgggcgcggcggctcacgcctgtaattccagcactttgggagaccgagacgggcggatcgcgagatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccag

SEQ ID NO: 121162 - DNA, 824 bp, Homo sapiens
  Payload ID: 3752
  Gene Symbol: CCDC74B
  Gene Name: coiled-coil domain containing 74B
  ENST ID: ENST00000423263
  CDS Start-End: 81-428
gtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacacc

SEQ ID NO: 121163 - DNA, 2371 bp, Homo sapiens
  Payload ID: 3753
  Gene Symbol: CCDC77
  Gene Name: coiled-coil domain containing 77
  Uniprot ID: Q9BR77
  ENST ID: ENST00000239830
  CDS Start-End: 180-1646
aacttcttcgcgattgcacggattcagggacgctcagtggcgccgcgccgctccttggtttgacttttgtttttcagttgcgttccctgactcggagtcttagtgtgtcgttatttggacaagaggcacattgacccaatttggagacgtattttggaaggaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaagat

SEQ ID NO: 121164 - DNA, 2338 bp, Homo sapiens
  Payload ID: 3753
  Gene Symbol: CCDC77
  Gene Name: coiled-coil domain containing 77
  Uniprot ID: Q9BR77
  ENST ID: ENST00000422000
  CDS Start-End: 250-1620
atccttccgcagctgcacgacgcctgtgtgtctggcctttccttcttcttctcttccccggcagcacagtgtggctgtttgtctccttgcccgccaaagttctgcccagtccaacgactccacgcagctcgcccttggttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactc

SEQ ID NO: 121165 - DNA, 2253 bp, Homo sapiens
  Payload ID: 3753
  Gene Symbol: CCDC77
  Gene Name: coiled-coil domain containing 77
  Uniprot ID: Q9BR77
  ENST ID: ENST00000412006
  CDS Start-End: 161-1531
gacttttgtttttcagttgcgttccctgactcggagtcttagtgtgtcgttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaa

SEQ ID NO: 121166 - DNA, 1652 bp, Homo sapiens
  Payload ID: 3753
  Gene Symbol: CCDC77
  Gene Name: coiled-coil domain containing 77
  Uniprot ID: Q9BR77
  ENST ID: ENST00000540180
  CDS Start-End: 198-1568
gaatccttccgcagctgcacgacgcctgtgtgtctggcctttccttcttcttctcttccccggcagcacagtgtggctgtttgtctccttgcccgccaaagttctgcccagtccaacgactccacgcagctcgcccttggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgt

SEQ ID NO: 121167 - DNA, 556 bp, Homo sapiens
  Payload ID: 3753
  Gene Symbol: CCDC77
  Gene Name: coiled-coil domain containing 77
  ENST ID: ENST00000535052
  CDS Start-End: 281-556
ctgcacgacgcctgtgtgtctggcctttccttcttcttctcttccccggcagcacagtgtggctgtttgtctccttgcccgccaaagttctgcccagtccaacgactccacgcagctcgcccttggtaaggggtcggggaggggcacaagctcttctttactagaggttggagtgcaatggcattatcttggctcactgtaacctcaaacttctgggctgaagcgatcctcctccctcagcctcctgagtagctaggactacaggtgtgaaaaagacagcatgaactttaccccaacacacacccctgtctgcagaaagcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaa

SEQ ID NO: 121168 - DNA, 1362 bp, Homo sapiens
  Payload ID: 3753
  Gene Symbol: CCDC77
  Gene Name: coiled-coil domain containing 77
  ENST ID: ENST00000543504
  CDS Start-End: 205-1362
ttcttctcttccccggcagcacagtgtggctgtttgtctccttgcccgccaaagttctgcccagtccaacgactccacgcagctcgcccttggttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaa

SEQ ID NO: 121169 - DNA, 1611 bp, Homo sapiens
  Payload ID: 3754
  Gene Symbol: CCDC78
  Gene Name: coiled-coil domain containing 78
  Uniprot ID: A2IDD5
  ENST ID: ENST00000293889
  CDS Start-End: 107-1423
agaggccttggcaacgcacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctggcaggcagtggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaagagacccggtggagcctcccaggggggaacatcagagccacagggcctggacgctgcatcctgggcccagatccaccagaagctccgggacttctcccgcagcacccagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaaccca

SEQ ID NO: 121170 - DNA, 1055 bp, Homo sapiens
  Payload ID: 3754
  Gene Symbol: CCDC78
  Gene Name: coiled-coil domain containing 78
  ENST ID: ENST00000345165
  CDS Start-End: 1-959
tgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctggcaggcagtggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaagagacccggtggagcctcccaggggggaacatcagagccacagggcctggacgctgcatcctgggcccagatccaccagaagctccgggacttctcccgcagcacccaggcagagctggaacgggagcgggcacagctgctggtccgggccacgatggctgaagagcaactttctgagctacaggagtacgtggaccagcacctgggcaggtacaagcacgaaatcctgaggctgaggaagctggcaggtgcaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatagaaccca

SEQ ID NO: 121171 - DNA, 621 bp, Homo sapiens
  Payload ID: 3754
  Gene Symbol: CCDC78
  Gene Name: coiled-coil domain containing 78
  ENST ID: ENST00000423653
  CDS Start-End: 452-621
gtttccgagttctccggcccctgatggggacgtctgcgcccctcttctcaggccagaggttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgact

SEQ ID NO: 121172 - DNA, 479 bp, Homo sapiens
  Payload ID: 3755
  Gene Symbol: CCDC79
  Gene Name: coiled-coil domain containing 79
  ENST ID: ENST00000559050
  CDS Start-End: 150-479
gtgcgtcgtggcaggtgagcggtgatgaagaaagggcggaagctcccgcttgagggtagacgccacggcctccgctcccgcgcgttgttgtcctgccttaccgcgcttggaaactctacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttctta

SEQ ID NO: 121173 - DNA, 629 bp, Homo sapiens
  Payload ID: 3755
  Gene Symbol: CCDC79
  Gene Name: coiled-coil domain containing 79
  ENST ID: ENST00000559403
  CDS Start-End: 1-76
caaagtcattgtggaagctgaagacagatataaaagtgaactaaggaaatcacttatctgtaacaaaagtaattaattcagcagctttaaaattaaattctgctgaccccacgtagaagacaacgactcagtaatgaatctactacccctggaggaataagtgaatatatttaatttaattttttttttcttgagacagggtctggctctgttacccaggatggagtgcagtggagcaatctcggctcactgcagcctccgcctcccaggttcaagtgattctcctgcctcagcctcctaagtagctgggattacagacatgtgccaccacaccctgctggtttttgtatttttagtagagatggggtttcaccatgttggccaggctggtctcaaactcctgacctcaagtgatccacccaccttggcctcccaaagtgctgggatttcaggcatgagccattgcacctggctgaatatatttaatttttaaatgaacttaaatttcatatatttctgagaaagaacagctgagtggttgttctcagtcttattattaatggatcttaaatgataaaccttgcctctgatgagggtcagaccttctaataaaagagactttcctcttc

SEQ ID NO: 121174 - DNA, 2257 bp, Homo sapiens
  Payload ID: 3755
  Gene Symbol: CCDC79
  Gene Name: coiled-coil domain containing 79
  Uniprot ID: Q8NA31
  ENST ID: ENST00000558713
  CDS Start-End: 74-2257
ctggtcggctgggcgggaaaccctgtcgtgcgtcgtggcagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgaggaaaatcagtatgacctttttaaaaacaatgggcttccactcatgattcaagccttaactgaatcgcagaatgaggaactgaacaaagctgccacatttgtgcttcacaactgcaaaaaaattactgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagtgaccatgtttttaaacacccagttcacattgccaaaaatataaagcagcagttaccagtaacagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 121175 - DNA, 2446 bp, Homo sapiens
  Payload ID: 3755
  Gene Symbol: CCDC79
  Gene Name: coiled-coil domain containing 79
  Uniprot ID: Q8NA31
  ENST ID: ENST00000433154
  CDS Start-End: 263-2446
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgaggaaaatcagtatgacctttttaaaaacaatgggcttccactcatgattcaagccttaactgaatcgcagaatgaggaactgaacaaagctgccacatttgtgcttcacaactgcaaaaaaattactgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagtgaccatgtttttaaacacccagttcacattgccaaaaatataaagcagcagttaccagtaacagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataaaaaaaagaagaattcgcaaaaactttactgaagaagaagtaaattaccttttcaatggagttaagaaaatgggaaatcactggaattcaattttgtggtctttcccctttcagcaaggacggaaggctgtggaccttgctcacaaataccacaagctgaccaaacaccccacgtgtgcagcttcttga

SEQ ID NO: 121176 - DNA, 2541 bp, Homo sapiens
  Payload ID: 3755
  Gene Symbol: CCDC79
  Gene Name: coiled-coil domain containing 79
  Uniprot ID: Q8NA31
  ENST ID: ENST00000313294
  CDS Start-End: 263-1789
gacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgctgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataatatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataagtgaatatatttaatttaattttttttttcttgagacagggtctggctctgttacccaggatggagtgcagtggagcaatctcggctcactgcagcctccgcctcccaggttcaagtgattctcctgcctcagcctcctaagtagctgggattacagacatgtgccaccacaccctgctggtttttgtatttttagtagagatggggtttcaccatgttggccaggctggtctcaaactcctgacctcaagtgatccacccaccttggcctcccaaagtgctgggatttcaggcatgagccattgcacctggctgaatatatttaatttttaaatgaacttaaatttcatatatttctgagaaagaacagctgagtggttgttctcagtcttattattaatggatcttaaatgataaaccttgcctctgatgagggtcagaccttctaataaaagagactttcctcttcccttc

SEQ ID NO: 121177 - DNA, 3213 bp, Homo sapiens
  Payload ID: 3756
  Gene Symbol: CCDC8
  Gene Name: coiled-coil domain containing 8
  Uniprot ID: Q9H0W5
  ENST ID: ENST00000307522
  CDS Start-End: 775-2391
ctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagttgagccaacatgcaaatcaaaaaacatttatgaactgatttcttagctttggacttgacaactgacgaatgctctgggggtgacctggcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgcattcaaaa

SEQ ID NO: 121178 - DNA, 12430 bp, Homo sapiens
  Payload ID: 3757
  Gene Symbol: CCDC80
  Gene Name: coiled-coil domain containing 80
  Uniprot ID: Q76M96
  ENST ID: ENST00000206423
  CDS Start-End: 955-3807
gaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgtatttaaagctttttcttattttttgtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagcacaggcataccatggagatattacaggatcagttccagaccaccataataaagtggatatcgcaataaagtgagtcacacaaaatttttggtttctcagtgcatataaaagttatgtttacactctttagtagtctattaagtgtataatagctttatgtccaaaaaatgtacatgttttattttaaaaatactttattgctaaaaattgctaatgatcataatctttttgcattgatgttgatggctgctgaatgatcagggtggtggttactgaaggttgggggtgatggtggcaatttcttaaaataagacagcaatgaagtttgccacttcgattgactttttcttcatgaaagatttctctgcagcatgtgatgctgtatgatagcattttaccagtagtacaacttcttttgaaattggagccaatcctctcaaaccctgttgctgctttattaatgaaatttatgtaatgttgtaaatcctttgttgtcatttcaataatgtacatagcaacttacgcgagtagattccatctcaagaaatcactttcttcgttcattcataagaagcaagtcttcatctattaaacttttgtaatgagattgcagcaattcagtcacatcttcaggctccacttctaattccagttctcttgctatttccactatgtctatagcagagcttcctccaatgaagtcttgggcctcttaaaatcatccatgagggatggaatcagtttccgaactcattgatcttcctattttgaccttctcccatgaatcacgatgttcttaacagcatctagaatggtgaatcctttccaggtttttaatttgctttgcccagatccattagcgggatcacaatctgtgacagttatagtcttacgaaaagtgcaaatgactccttgattcctgtgctgcacaataggtattgtgttagcaggcacgaaaatattaatctccttgtatatctctatccaagttcttgggtgactgggtatattgtcagtgaacagctatatatatatatattatagtggtctggaactgatcatttatatatatattttatatacatatataaaatatataatatatattatatatatatatatttttttcgagatggagtctcgctctgtcacccaggctggagtgcagtggtgcgatcttggctcactgcaacctctgcctccggggttcaagtgattctcctgcctcagacccctgagtagctggatttacaggcgcccaccactacacccagcttatttttgtatttttagtagagatggggtttcaccatgttagtcagggtggtctcgaactactgactttggcctcggcctcccaaagtgctgggattacaggcatgagccactgcgcccggcccgaacagcaatatttttaaaagattctttttttttctgagcagtaagactcaaaaagtgagcttaaaatgtccagtaaaccatgctgtccatagacatgctgtcattcaggctttgttgctccatttatagagcacaggcagattagatttagcataattctgaaaagtcgtaggatttggggaaatggtaaatgagcattgatttcaacttaaaatcaccagctgcgttaacttctaacaaggagtaagcctgttggttgaagctttgaagtgaggcattgactactcctctctagatacgtaagtctgagatggcatcttcttccaatataaggctgtttcatctcttttgaaaatctattgtttagtgtagccactttcattaattatcttaactagatcttctggataacttactgcagcttctacatcaacatttgctgctttactttgcacttttatggatgcacaaggcttcttttcttcaaactcatgaaccagactctgctaccttcaaactttttttctgaagcttcctcacctccctttagctttcatagaattgaagagagttagggccttgctctgaactaggctttggcttaagggaattttgtggctggcttgatcttctattcagatgactcaaagtttctccatatcagcagtaaggctgttttacttttttatcattcatgcattcacaaagtagcacttttaatttccttcaagaacttttcctttgcatttacaacttggttgtttggcataagaggcttagctttcagcctgtctcagcttttgacacaccttcctcactaagcttattcatttctagcttttgatttaaagtgaaagattgcaacttcctctcacttgaaatacctggaggctattttagggttattaattgatctactttcaatattgtgtctcagggactaaggaggcctgagaagaaggagaaagattggagaaaggttggttgttggagcaatcagaacatacacacatttattaagtttactgtgttatataagtgtggttcatggtgcccccagtaattataatagcaacatcaaagatcgttgactacagattttaataacagagataataatgaaacagtgtgaaatatggcaagaattaccaaaatgtgacacagagacataaagtgagtacatactattgcaaaaatgatgtcaacagacttccttgatgcagggttgccacaaaccttcaatttgtaaaaaatgcagtatctgagaagtataataaaataagatgtgcctgtacttacttgctaatggacctattaccatactggcatcttataaaaaaaattacaaggaaggagattatatccagggattctttttgttttcaaggcaaaggttaccaagttacaatggaccaaagtagctggaatgcaaaggagtataatccttgtctttgaaaaaagagcatttgtttcaatcatatggcatatcaaagtaaactttctcccttcctccctcctttcgttgctgctgcttcttttttttctctttttttttttctttttttggagagggtctcactctgtcacccaggctgcagtgcagtagtgcaatcttggctcactgcaaactcagcttccctcaaacaatcctcccacctcagcatcccaagttagctgggaccacagccatgctccaccatgcccagccatccttgcttctttactacatttcttttttcaacaaatatttatcaagtaatattgtcaagtaatatttatgagcttcccctcagataggcatttagcatcatgatggcaccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaaatggaatttatagttcaatgaacttgacaaatcacttattctgccattcattttccataaagaccattcattcttccttgttttacaggtaactgagctccagaaagctcaagtgactttagaactcagttcttagtgtgtgaattatgctcccatctcatccctcttccttgatggagcactttcctcctcattttttcttggatagtctgtacaagctgcctgaggtgtgcaggaaagtgagccacgtcgaagtgtactgcttttaaatttttgccaggatgaagcatagcccaaagttgccaataaaaatggatttctttacctttctgaaattgtgtgatgacaatttctaagtaaaggacccaaatcatgtcaacttcaggaaatataataatgagggagccaggagcagtgaggggctcacacctgtaatcccagcactttgggaggccaaggtgagcgggtcgcttgagcccaggacttcgagaccagcctgggcaacacggcaaaaccctgtctctacaaaaaaatacaaaaaattagctgggtaaggtggtgtgtgtctgtggtcccagctattcaggaggctgaagtgagagaatcgcttgagcctaggaggtcgaggcttcagtgtgccgtgatcgtgccacagcactccatcatcatcatcctgggtgacaaagtgagaccctgtctccccaccaaaaaaaagagggagtttcatctcccaagaaaatgaattagataggaataatagaaaatttactctcagaataatagggttctagctcctgcaaccaaaaaaagatagttcttttttacaacctgagattactttttcaagcatttctccagttccactggcattgaaataatagttagcaatgcatctgagcttttcttcctctaatgagcaggcagagaagtcatagatcatcatttggaggactataaaataagacatagcttagcaaaaggaccaaaatacattcagaggaggatgctattggtgaatgtcctcaaagcctataatctggaaaaatacaaggcatatctctgaaactgtgaggattagcaaactagctaacctgaatctctgtcttctggtagtataaactaggtagtttcaaatctgagtagtttctccataaaagcatttcttcccaaacgtttcttaccaaactcccaaataaatgagaaaaataaaatacagttttataatttttgagaaagattatgggattatggtatttaaaaagaaaagcattctgtagagttggggaaatctggaagactcttgaggacatagctttgccgaaattgctggttgtcacaagactcttcaaaaactacttttcatcagacatctcccagggctctgaggtgaatattaattcagcagaaagatccttttctgctacataggcaggaggtccagacacaggggagtgggtgcaacccagctggtcccattttctgtaatataattaacaatgaagctcatactttctcaacttctagaagcctggaggatggaagcagcccgagagtagggtgaatgatggcctcagtgggcccttcttaatgtgtctcagtactgaatgtgtggagattgtagaaaaatagaaggcccttggaaaaaacctctgttcgtttctctgttcgtttcgctccctgatctccctgccggattgcttttctttcctttctcttccttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgaggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagaggccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctggttgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgatta

SEQ ID NO: 121179 - DNA, 3557 bp, Homo sapiens
  Payload ID: 3757
  Gene Symbol: CCDC80
  Gene Name: coiled-coil domain containing 80
  Uniprot ID: Q76M96
  ENST ID: ENST00000439685
  CDS Start-End: 389-3241
gagaattttctccttccaaagtacagtgtaagaacagactggaagagaagttaccccgatgacttggtttggaaggggttaaggcaccagtcatcctcttctaaagtgatttatgatgatgtgtggagtttaaaaactttaccccaccccaaagaacagccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaagtggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgta

SEQ ID NO: 121180 - DNA, 681 bp, Homo sapiens
  Payload ID: 3757
  Gene Symbol: CCDC80
  Gene Name: coiled-coil domain containing 80
  ENST ID: ENST00000479368
  CDS Start-End: 45-681
gaagttacaacagaaaaactacaggagtgtagcaatgcagtttaatggctttgagaagcatgggacagttctctgtttttttctttttttttttctgggcacagaaaaaaattgctagcctaagtcactctggtttcctacattggtttttattgtttgaagcagtaagcagtaatggtgtcctgctttttttttccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttacc

SEQ ID NO: 121181 - DNA, 781 bp, Homo sapiens
  Payload ID: 3757
  Gene Symbol: CCDC80
  Gene Name: coiled-coil domain containing 80
  ENST ID: ENST00000461431
  CDS Start-End: 1-781
cttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtac

SEQ ID NO: 121182 - DNA, 2510 bp, Homo sapiens
  Payload ID: 3758
  Gene Symbol: CCDC81
  Gene Name: coiled-coil domain containing 81
  Uniprot ID: Q6ZN84
  ENST ID: ENST00000354755
  CDS Start-End: 429-2117
tagcaaccgagcgagcctttctcgcgtcccagcaacgcgcccttccctctgccgggcctattctccctggtgcccctcccttcctcgaggctgcagctcacccctcattgggtctctcgttggtcaggagggcgcgggtctgcacactctcactcggtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagggggttcagattccagcatttggaactttcactttcataagacaaaagcttgaggtgggaaacaacaaatttatcttaatccagaggcctgtgtttatcatggtggagaagctagtgcagattcatggactcaaacaaaacaaaaggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacaggaaatgtgctatgtatgtttgcaacgagcacaacgaaattccctgttgtactacagtgaggaaaggaggagagagatagaagatgagagactcatacagcagtatcagatgttaaaggatcaggaggctctcttcagacaccagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatattttttaagcgcctg

SEQ ID NO: 121183 - DNA, 2528 bp, Homo sapiens
  Payload ID: 3758
  Gene Symbol: CCDC81
  Gene Name: coiled-coil domain containing 81
  Uniprot ID: Q6ZN84
  ENST ID: ENST00000445632
  CDS Start-End: 273-2231
gtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagggggttcagattccagcatttggaactttcactttcataagacaaaagcttgaggtgggaaacaacaaatttatcttaatccagaggcctgtgtttatcatggtggagaagctagtgcagattcatggactcaaacaaaacaaagtatatactcctggtgaaatcccaattgttccacttaattttgtcatgatatccctggagggtccatttaacagagatgtagtggaaggatgtgtgaaggagacgttgctttttttatcgcgttccatttccatgaaacaaaatgtggagtttacattcaaaggaattggggtcctcatgatcagagacagcaaagtgaagatgaggttttataaagacttcctttgtaccatggatggaagtggggctttggcaaaggccctagcaaataggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacaggaaatgtgctatgtatgtttgcaacgagcacaacgaaattccctgttgtactacagtgaggaaaggaggagagagatagaagatgagagactcatacagcagtatcagatgttaaaggatcaggaggctctcttcagacaccagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgct

SEQ ID NO: 121184 - DNA, 543 bp, Homo sapiens
  Payload ID: 3758
  Gene Symbol: CCDC81
  Gene Name: coiled-coil domain containing 81
  ENST ID: ENST00000531271
  CDS Start-End: 278-543
actcggtgccggacatcagttcctgcggctcttgctgtgggagctgcccgagagccagagcagtggggagggacggcgagaaccaatgtttaagtttatttaagaaagaagaaaaagagtcaagaagttcaagattttcgtcactcttatttttaaggcacatccaaagctccgtggagaaggggctggagggtgggaaaattatttttgtgcacattccatataagaaagaagagacccatcgaacattcagtacggagtcacctggaaattggagatgttggatacgatcgcccgtgccctgcaggacctgggcaggcaggtgctgcccactctgccctcgctgagccaggaggaagtctctattatctgggggaatgtatcagaatttgtgagacggcagttaaccctgcacaagaggcctggcactgtggactcggtgttgtctagcagagaggccttgaggaagtggcccagcagtgtgcttgcgtttccaaggattgagctcaaggagatggaaaacaaactgcctatggagaccct

SEQ ID NO: 121185 - DNA, 1814 bp, Homo sapiens
  Payload ID: 3758
  Gene Symbol: CCDC81
  Gene Name: coiled-coil domain containing 81
  Uniprot ID: Q6ZN84
  ENST ID: ENST00000528728
  CDS Start-End: 257-1420
attcctcattggatttttaagctctggacttataagcgcttaacataaacaacaacaagaaaagtatcgtggtagccttgcctatgagcctgcagtttttaatttgtctgagtcctggacctcagcctagatgtaaccttgctctgttgctgtcctctagaggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacagatgaaaagtctggctactagagaacagaatcagaaaaatgctgcctataatcttggagttgctgaagctataagaaaccacaagaatgagaaaccggaattttataaatccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatattttttaagcgcctga

SEQ ID NO: 121186 - DNA, 2941 bp, Homo sapiens
  Payload ID: 3759
  Gene Symbol: CCDC82
  Gene Name: coiled-coil domain containing 82
  Uniprot ID: Q8N4S0
  ENST ID: ENST00000278520
  CDS Start-End: 430-2064
ggctcactggggactcctttaaattttgcaattggtgttattaataagatgataagagggaagtctgcaaatactcttttcttgcctggtggataataatttacagaagtttctggcctaactcgtgcagtaaaattcggttacataattttttaaaaaagcatatttgtaaactctaaaccattttaatcgttatttttctgaaactaaaatacagcatgaatgagagataaaaataatgatttttaaaggcttaatttttactatcttgtacaaatgtgatattggcagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 121187 - DNA, 1878 bp, Homo sapiens
  Payload ID: 3759
  Gene Symbol: CCDC82
  Gene Name: coiled-coil domain containing 82
  Uniprot ID: Q8N4S0
  ENST ID: ENST00000423339
  CDS Start-End: 244-1878
cagcacaacatacaacgtaattcagagtagatgttcatataattatttcatgggcattcagtaaattatttgttaaattaatgttctaccatcttcactcagatatttcatgtgattttgtgtttgtggaccattaaataaagccaaataaatataatttataccataaatgcattcattgctctaatctggttatcactgttatattcctaacaactttattttatagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaa

SEQ ID NO: 121188 - DNA, 236 bp, Homo sapiens
  Payload ID: 3759
  Gene Symbol: CCDC82
  Gene Name: coiled-coil domain containing 82
  ENST ID: ENST00000530203
  CDS Start-End: 147-236
atctataggaaaaaagtaatcctcttggaaagctggaaacatagtccgattttttatagtgtgtggtttatagaaagactccaggaatattctgtgctgtggtggaaatattggaataatcagcctcataagaagcttaagtgaaaatgatacatgttagaagacatgaaacaaggagaaattctaagagtcacgtgcctgagcagaaatctcgagttgattggaggcgaactaaa

SEQ ID NO: 121189 - DNA, 849 bp, Homo sapiens
  Payload ID: 3759
  Gene Symbol: CCDC82
  Gene Name: coiled-coil domain containing 82
  ENST ID: ENST00000538597
  CDS Start-End: 63-849
cggactagtgggctagcgggcgctgggttcctgcgtcccgccaaagagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgagg

SEQ ID NO: 121190 - DNA, 2358 bp, Homo sapiens
  Payload ID: 3760
  Gene Symbol: CCDC83
  Gene Name: coiled-coil domain containing 83
  Uniprot ID: Q8IWF9
  ENST ID: ENST00000280245
  CDS Start-End: 513-1847
aaatgcagggcgcagcagccgctgcagtggagccggtaggcctggccggcgggctgaaaggaagtgcgagctgtccgcccagggccgggtatccgcccctgcaggctgtggaggggatgtcaggagactggctggcctcttttcttggcccccgactccttccagtctgacactgaagactttataagcttccccccgaccaccctccacgggctccactctccacgggcctgggcttgcgccgcttcgagatcagcctgggggtcgcgccctcctggtcttgtccacgaagcgccgttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggtatccagtgctacattcctgtcccacctctaatcctcgtcatctgctgctgctgcctttggaatcatgtctaatctctgccaggcgttgctggcgactatatcttacccaagctgctggactagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactgggtaatttataaa

SEQ ID NO: 121191 - DNA, 1969 bp, Homo sapiens
  Payload ID: 3760
  Gene Symbol: CCDC83
  Gene Name: coiled-coil domain containing 83
  Uniprot ID: Q8IWF9
  ENST ID: ENST00000342404
  CDS Start-End: 217-1458
gttcttgggccgttaggagctgctgggaagggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggcgactatatcttacccaagctgctggactagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactgggtaatttataaa

SEQ ID NO: 121192 - DNA, 1029 bp, Homo sapiens
  Payload ID: 3760
  Gene Symbol: CCDC83
  Gene Name: coiled-coil domain containing 83
  ENST ID: ENST00000526729
  CDS Start-End: 1-956
ccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagaggttgcaattcacaggaaggaagttgaagaattaaaaaatgctattcatgaactggaagcagaaaatttggtgcttattgatcaactatccaactgtagacttgtggatctcaagatacccaggcgactatatcttacccaagctgctggactagaagtgccacctgaagaaatgtctttggaattgccagaaacacatatagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgccc

SEQ ID NO: 121193 - DNA, 1202 bp, Homo sapiens
  Payload ID: 3761
  Gene Symbol: CCDC84
  Gene Name: coiled-coil domain containing 84
  Uniprot ID: Q86UT8
  ENST ID: ENST00000334418
  CDS Start-End: 57-1055
gccgccggatggcgtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaaaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaacaaacccctattataccttccaccaaattctttatcattgtctttcttaggaaacagacatactcattcatttgatttaataaagttttatttttccaaatgta

SEQ ID NO: 121194 - DNA, 1119 bp, Homo sapiens
  Payload ID: 3761
  Gene Symbol: CCDC84
  Gene Name: coiled-coil domain containing 84
  ENST ID: ENST00000532132
  CDS Start-End: 31-615
ctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagaggttggtttccctcggaggatccagaccacctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaatttccctatcattgtacagaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaa

SEQ ID NO: 121195 - DNA, 1295 bp, Homo sapiens
  Payload ID: 3761
  Gene Symbol: CCDC84
  Gene Name: coiled-coil domain containing 84
  ENST ID: ENST00000526463
  CDS Start-End: 44-490
gtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcggctatgtggttcatctgcaagttttttcaaattgttgcaaatctccaaaaaaattttcaagtgaactcgtgcagttcaaacttgtgctgtgcaagagtcaactgtatttgcttattttctcaaaaaggaatgcctaaaggataatcaagaaactaatgaaactgccagatgtggtggtgcacacctgtagtcctagctactcaggaggctgagattcaagaaatccatggtgaaaggtttggattcctatgaagaaaaggaggataaagtgatcaaggagatggcagctcagatccgtgaggtggagcagagccgacaggaggtggttcggtctgtcttagaggttggtttccctcggaggatccagaccacctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggtgccacacctccctggatgatccaagatgaagaatacattgctgggaaccaagaaataggaccatcctatgaagaatttcttaaagaaaaggaaaaacagaagttgaaaaaactccccccagaccgagttggggccaactttgatcacagctccaggaccagtgcaggctggctgccctcttttggccgcgtctggaataatggacgccgctggcagtccagacatcaattcaaaactgaagctgcagcaatgaagaagcagtcacatacagaaaaaagctaatcatgctctctaccaactaccatgaggctaaaagcaaagtcaa

SEQ ID NO: 121196 - DNA, 1119 bp, Homo sapiens; identical to SEQ ID NO: 121194
  Payload ID: 3761
  Gene Symbol: CCDC84
  Gene Name: coiled-coil domain containing 84
  ENST ID: ENST00000626123
  CDS Start-End: 31-615

SEQ ID NO: 121197 - DNA, 1295 bp, Homo sapiens; identical to SEQ ID NO: 121195
  Payload ID: 3761
  Gene Symbol: CCDC84
  Gene Name: coiled-coil domain containing 84
  ENST ID: ENST00000626384
  CDS Start-End: 44-490

SEQ ID NO: 121198 - DNA, 1202 bp, Homo sapiens; identical to SEQ ID NO: 121193
  Payload ID: 3761
  Gene Symbol: CCDC84
  Gene Name: coiled-coil domain containing 84
  Uniprot ID: Q86UT8
  ENST ID: ENST00000625528
  CDS Start-End: 57-1055

SEQ ID NO: 121199 - DNA, 3982 bp, Homo sapiens
  Payload ID: 3762
  Gene Symbol: CCDC85A
  Gene Name: coiled-coil domain containing 85A
  Uniprot ID: Q96PX6
  ENST ID: ENST00000407595
  CDS Start-End: 503-2164
gcgccgcggtgcccggcgcgccctccaagctaggagaggggagaagccgggggctgcagctgggcaagggggaggaaagtgcgtgtgcgtgcacgcctgtgtgcagggcagagagtgcggggggcgacagtctcggcttagggcggaggagagggcaggggaacggcggtgcagctcccccgctgtccccgaggatttcccgcggcagccccgggctccccagtgcccctcaccatggacttgcgcggagttgggacgggcctcggcagcagcaagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcggcggcggaaagttgttccccagccccggccggctcgtccgcggccccgcccgcgccggtggaggacctgtccaaagtgtcggacgaggagctgctgcagtggagcaaggaggagctgatccgcagcctgcggcgcgccgaggcggagaaggtgagcgcgatgctggaccacagcaacctcatccgcgaggtgaaccgccgcctgcagctgcacctcggcgagatccgcggcctcaaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccggaacacttccagaagcaccggtcagggagcagccctgaacacgccaggcacagtggagggagcccggagcatcttcagaaacacgctcttggggggagcctagagcatctccccagagccaggggcaccagcccggagcacctcaaacaacattatggagggagccctgatcacaaacacggaggaggcagtggaggaagtggaggcagcggcggaggcagcagggagggcaccctcagacggcaggcacaggaggacgggtcaccccatcaccggaatgtctacagtggcatgaacgaatcaaccttgtcctatgttaggcagctggaggcaagagtaagacagctggaggaagaaaatcgcatgctgccccaggccagccagaatagaaggcaacctccaactagaaacagctcaaatatggagaaaggctgggggtccagagcccggcgggtcttgcagtggtggcaagggtgccgaggaataggacgatgcctgcctactctcccgggttcttttaggttgtcatcaggggctgatgggagtaacagttcacccaactctgcagctagcttcagtggacatgccacaccttcccagcagcctgaacctgtggtacattctcttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattgggaaacctgaatagttttaagagtccagtggagcctcagtgttttgaatagagatgactcattacacataatggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctcac

SEQ ID NO: 121200 - DNA, 1524 bp, Homo sapiens
  Payload ID: 3763
  Gene Symbol: CCDC85B
  Gene Name: coiled-coil domain containing 85B
  Uniprot ID: Q15834
  ENST ID: ENST00000312579
  CDS Start-End: 673-1281
ttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcgga

SEQ ID NO: 121201 - DNA, 16393 bp, Homo sapiens
  Payload ID: 3764
  Gene Symbol: CCDC85C
  Gene Name: coiled-coil domain containing 85C
  Uniprot ID: A6NKD9
  ENST ID: ENST00000380243
  CDS Start-End: 68-1327
ggagccccggcgcggggaagcgccggccgggcgagggcgagggcgatgccgcggtgacggccccgccatggctaagcccgcggcgacggcggcggcggcgtcggaggagctgagccaggtgccggacgaggagctgctgcgctggagcaaggaggagctggcgcggcggctgcggcgcgccgagggcgagaaggtgggcctcatgctggagcacggcggcctgatgcgcgacgtgaaccggcggctgcagcagcacctgctggagatccgcggcctcaaggacgtgaaccagcggctgcaggacgacaaccaggagctgcgcgagctctgctgcttcctcgacgacgaccggcagaaggggcgcaagctggcgcgcgagtggcagcgcttcgggcgccacgcggccggcgccgtgtggcacgaggtggcccgctcgcagcagaagctgcgcgagctcgaggcgcgccaggaggccctgctgcgcgagaacctggagctcaaggagctggtgctgctgctggacgaggagcgcgcggcactggcggcgacgggggccgcaagcggtggcggcggcggcgggggcggcgccggctcccgcagctccatcgacagccaggccagcctgagcgggccgctgtcgggtggcgcgcccggcgcgggggcccgcgacgtgggcgacggcagcagtacgtccagcgcgggcagcggcggcagccccgaccaccaccaccacgtcccacccccgctgctgccccccgggccgcacaaggcccccgacggcaaggcaggagccacacgtcggtccctggacgacttgtcggcgccgccgcaccaccgcagcatccccaacggcctgcacgatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacagggattttgatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcatgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatctataaatgaaaaatgtggttcttctgccccttctgggtgtcatgggagagaatgtcaccgaatgaaaatgacaacagcttggcttcagatggaattggactatttaaaattgagtttccaggaaaaataggcactgatttctagaaggaaattaactccttaccgaagctatttattgagccaatatggctggttaacgtcctcactagtataaagtaacccagtgcaggactctcagacattagctgaaccaagtgtacacagtcagactgcaagggcactgatgaggctactctgaaagctggttgtccccgtcctctaggtgtgaggaccactctgattttatcccaggggcccggtccattcttcccatactgcaactgtcgtgcattatacaaggtaccctgctgcttacccacttcaactactctgcaagtcgattagaaaatcttgttaaaaaaacaaagagggaaaaaaggctcacgttatctcatccaggctgcccgccccagccccccaactggaggcatgccgggtgggggaatgggcgggggcacaggaggctgtcctccaggggggacggcaggaggtgggtagctggctggcggcaggcccaaccctggaggaggatgaggggggactgcgtgggtaggcgggaggcgtgggggtgggggtgggaagttggggttgtaggtgggtgggggtggggggtagccaggagtagggggtgggatggcaggtggggggaaggaggctgggggaggaggcacaggtggcgggggcgggttgggcgggtagacatgggggtggtagggcaggtgtgcaggtgggccgtaggcggggggcagggcaccgtaggagggtccctcggtcttcatcatggactgcaggctctggtagccctctccagacatgtaggagctggtggtggacatcccggtcatgtagctggaggggggtgggggcgggggccggtgtggcagcggcggtggctggtgcacaggggccgggtgggccggagggggaatctggactttggggaggtcagtggcatccacagggcccggcggctcagcctcacctaaggcagcagcgaggggaggcttccggtctgcaggagagagacgcatcagtgcccggcctccgccagcaatggttgctttttcagtgcctcctggcccttcagggccatctttacagaggagcagggagcagctgcccgcctcctctgtggcccaacgcatgggcccatgccccatgtcctgatgccaccagatgtctccccaccatctgtcaagaaggccctccaccctgtctgcgacgacctggggttttccctccctcagccctgaccacaccacctacaggcagtctcggcagcacccgaagcccccttgtgccctggccccagccccctcttcctagtgcaaaacgtgtgggggctcctctgtttttctgccttcagaaactgaccccaggggtcagggccacactgaactcctgtctgcagcagtggcattttgcagaaaacctcagagttagtcaaatgaatgtgatggcacttaaaacaattctgtacaagtctctgacattcccggtgtacccatcgaagcagcaattcaggttctattctactcaagagaggctacatcaaaccccactgtgtgctctcagatagcagcctccttgagaggagtgtgtgcatgtgtgtgcgtgtgcgtgctgcgtgcgtgctgcatgtctgtgcgtgctgcgtgtgtgtgcgtgctgcgtgtgcagcagggacaggcagcactaggtgttgagcacgcccaagatactcgtgctcagaaccagcctcaggcccctcccacagcgcctcccaacccatgagccctcacgcccccttctgccaaagccttatttaacatgttttggcctgtgatcccgggtcaccgtcagaccactggaaaatgacatcgcaacaccccaccacaggtagccaaacacacagaatgagtgtcctttcccaaggcagcccaggagacagaccacaggagcaacatttctggttccagagaacatagagaggacaaagccacgaagatgcttctggttccccaggcacttgggttaggcaaggcacagcacgacatcctggttgggtagacgtggccattggcacacaacccgtttgatcttgccaaagcgagcatgagcaggatttcatcaggtcggtaacaggtgtgccactggtgtgccacatcagcaccccgccagcctaccgggtaggaaggtcatatgtgcctggccttagataactggctttggctccaggtcagggccagatgccctgtggttctaggagctgactaaaaaagaggtgcagaaaagtgctgacacccttcaatgcctcctgtgtgtcactccacagccacctgggcccacaggcctgctcctccaccttgcagaaatcaacttttccaacactcgaccctgtagcctgaatcttcaagtcaccagtgtgcctgcccttgtgctgtgtgactgagctggaacagcaagtgggggtctctcctgggcaccccattccctctctgtacacttgctcctgaccaagtcccacacactgccaccaaactgctccctaaacatcactgctgacctgaatgcctcttcccatggcctagggcctcccaggaagcgtacttccctcccttcctcacggcccagctttactgcgcctcccaggccctgctctcttcagccatggcctcctggcagtgtatctggcacccaggtcccactcaagtcccaggcctactcctggctatctgtaatgggggagggagcagagctctgaggcctccacagcagctactcagtgccctggaggtagcagcacccctgtggctgccccaggctccccagataaaccacccatctcctcagtgaaggcacagccccaggctcggaccaggggaactgcacttggcgaggaggtgctccataaatgcttcatgagcaaccacaggcatttaagtaaggttcatattgaattgggggttttgggatttggccccaaagtggaaaatgacgcctctgttctcccaaagcacaaacactatcatgattgagtaggaacagaaatgtaatctgtggcacatctgttacgggcacacagtgctgtcagccccagtgtgagccacgtgcaccgaccaacagtgagtgtagcaggctggaggagctgctgacagaggcttggaagcctccggagtatcgaccaccttttggagagcaagcacaggtcactctggccttctctagcgcatcaccttctgaaatggtgccacaggtaaagaatgccatctactttacagcttttctcctctattgccagcggtatcagagaggctttccagcttaccatgtactacttgttgagaacttttcactctttcatttactctctgtacaattgcttattcttcagaatgcactaagacgacacactgccaataggaagcaggtgtaggggcggccggagcctagtagccacagtaaccctgcctctatctcagaaggcggggtttggctttctttcctaaaactgattctaatacaatgtgtagtttagcatttctggatgtgagaggtcggaaaatattcagatatacttaacaatttacaacattctcaaaatacctggtcaaaatcagaactttgagacacggtctccctctcacccaggctggagtacggtggtgcaatcatagctcactgcagccttgactgcccagggctcaaatgatcttcccatctcagactcctaagtagttgggactacaggtgtgtgctaccacacctggctaattttttagacagggtctcactttgttgcccaggctgacctcgaactcctggggtcaggtgattctcctgcctccgcctcccaaagtgctgggatcaaaaacacaagccattgtgcccagcccaagaacaattttgcaaagattcctgcctgtggctgacattgtcaatctgggccccagtctcccttttctaagttcccaggacctgctgcgtccaacattcagaggcgatgtgcacagctggccaagctgcttcagcagatgcttacctggaggtgggtgggctggaggcaacggtggatgagtggtctcaattttggggattttaggtggtggtggttctacaaagaaaaagcagattagaaaaccactcatacttcttcacatgaataagcatgtcataaagaaaaatgtactggcagagatttctttgggagaaaaacaacagagatgaccaaggctttaagggaacttgaagaaggtttcagctaaaccattatgcatgaatcctgttaacaaattaaatgccacctccctccaaaagacctgcgagcttcccacaggcagcccattttccatgtctacctaagtttccttgctgaccacttcactcaagtccttccgaccatgtgagaccagcagagcaacgtcttcatgagcatgtatgacctatctggagtcctccctggtacagaggacacaaagaagggtccagagtagcaacatcatgtcactgagtcccctgagggttccacaagagaatctctatcttttcattcttagacatagtttattctctctttcccaaatactgacttccagttggcagcatgtcagaagcagcacattaactggagtcagcagagctctggaggttgacacactgatggcaggaagaatgtgccgctcacaaaagcccagcagtcaggaccccttgaggtggaggaaacagcccacccttccggggtcaggcagcggcacgcagccagaatccacaatgacagcactaggtctccaaggcagcccaagggaagtccaatctcatccgtttaagaaggcagcgtgcacatcacaactgaaaaagaaccctatttttctgtttgcatgctgaggctttttcttcctgaaatgtactttcttctggcttgtacaccactcagatctgagtctcctctgccatcactggcctctttctctggatttcctccatctcaaatacaggctcaatttaagttccagggacttcctctctcttcaccctcttcctcagagtccaaagcccctctctaagtggacaactacaaacctacatttctagcgtccatcttgccaccaaaaccatggcccatccctagacccaccaatcagcacctcacactctaccttttgcctctgtatcctataactgctattactctcacctcagggacccacctcctgcctttttccacagctggtaatagttagctaaagccgtctacatcagggctgtccaacagcaatataactgagagccacatatctacaattttaaactttccaggagccattttattttttgagacagggtctcgctctgtcacccaggctggagtgtagtaatgtaatcatggctcactgcagcttcaaccaaccaggctcaagtgatcttgctgcctgagtctcccaagtagctgggaccataggtgtggcgccaccacgccgagctgatttttaagttttgtgtagtgatggggtcaccctatgtggcccagtctggcctggaactcctgggctcaaagcatgccttggcctcccaaagtgctgggattacaagtgtgccaggaaccactttaacaagaaaaaggagcactccagcctgcattaacagagcaagactctggaaataaaaggaaaaaggataaaatttatttaacccgatagatcgaaaattttatttcaacatgtaaccaatataaagctttactaatgagatgtcttacgttctcctttcttggaaatctctgtgtattttgcattgtcagtgcttcagaatttgacccagtcacatttcgagtgcttgcagccctctgcagccagtagccttcggcatggcacagtgcagctgagttcctctataaagcttcctccggatctgcccttcctgccccgcagccagcatgctgaggccaccatgtttcccatgagtgccagcaagattctccccattcctaaccacttgccctatttactgctgccaggggactccttctcaaatgaatttagactctgccattcccctgctaaatctccaatggcttcccttgcctctgccaaactcacagtcctccaggtaaactctgtgatctggtcctaacccacattttagatcctatcagaagctattgcctttcaattcatcacattccagaaagactcctctccatttcccctgattctcaattcctttgctcacttgcgtacttccaacttattgctccatcctccccctctgctctcgctgctcaaatgcaactcttccttcaaggtcatatatagtttgtttcctgcctctgacagacctgcacgtcaactcaattgcatttcatgtggcatggagtgtagcccgttcttgtgtctaacatttaatgtcggtcaatttgaagctaattaaaaaattcacctgtaggctgggcacggtggctcatgcctgtaatcgcagcactttgggaggctggggcgagcagatcacctgaggtcgggagtttgacacctgcctgaccaacatggagaaaccctgtctctactaaaaatacaaaattagccaggcctggtggtgcatgcctgtaatcccagctactcgggaggctgaggcaggagaattgcttgaacccaggaggcggaggttgtggtgagttaagattgcaccgctgcactccagcctgggcaacaagagtgaaactctgtctcaaaaaaaaaaaaaaaattcacctgtactgaactcatcattccctcaaatatactggaaaaaaaaaaaaagtagctctatcataactggaagatttcacagcagtttaatgaatggaactaagaaccgagaacatggttctaagaaccaggaactactggaactaagaaccaagtaacaaagaaagacaaatgagtcaatagggtctgtgccttcaaagagttcagtatgataggtggactgaccctgtgacaaaacatttctaactttctgttttgtaattgttccaattttgctcactccttctgtttatttccaatattgacatgaactaactttgggttctagacatgtgacagcacctcaacccaagtgtgtttcaaagaggccttgcctgcaagggcagctgggctgggccgggctggtgctgtccgggcagcacaccaccccctactgcccccccgcatctgctgtggcttggtgcttgggagaggactcctgctgctgtgatgggggtaaatagtctctaaaaataaaattgcagcaacagttctcctacagccataattatacttttatatatgttactgagtacatttttattgccagtaatgttttctgtactgatagcttcgtaagagcacaattttagaatctatgatcaggtgatgaacagaaagacaatgctgatggaaaagttttgtatgagctctaaagttaagatttaaggccaatttagatctgaaaagaaacaatgttggctaagaatttaaagttttgcatataaacacataaaactaaaaaaacatcagaacaggaaattacctgctgctttgttctcttctttgggagaaacaacctgttacaaaagaaaatacacaattgttaactgggatcctgagtatgatgagaaaaaaatggattatccaggtaccaccagaatcagcgacggcagtcactgtgaacagcctcggacaaaaattatttctagcctgaactttcagggcaaaccacggcacctaccagatcatcatttctgctcccttcctctttccatttaccaaataagacagaatgactagctttcctgaatggtgagttctgagtaaacactaagtttcaggaccacttgggtgcaggaaacggtccactgtttggggtcaggcagctgcacagaagcagcatgcacaacgacactgctaggacacggcaacgacaccgacaggcttcagaaccctggcagggatgaaacaggcagcagggctggagccgggcagagagccccctcctggttctcagaggcagcctgtccttggagcacctttgttttcaggctccccaccgacaagcagtcggactgcgagtttcggcgaacaccccctgcttccggtgttccctgtgctcgcttagaaatgggaacagtgctcaggtgttgccgccacctggaaagcctgctctacccagggcctgctttagcccactcaccacggctcgcttaacctgtcggggagaactgggctgcggagagggtttcttgggctgttgggctggctgctgctgctgggctggttgctgggggtccttctgctggggctgggatggttcggagctttgagacggctgtgactgctgtacttgcggcacttgtggtgtaggctgaagagatgggggctgttgcagctgatggggggtgtgatgaggcatctgttgttttccttgtgagtaaagatccaggatttggtggcagatgtctaaatgatagccaacaattacattttacacaaattggtattttaaataaaattttacctggataaagaatcagttatgatacccctacgaggacctaagcatgaatcacatttacaactcaccccatcttcgttgtgtgcaacactggtgtgtatttttagtttaccaaaagtatgtgtttggacaaagtggaaactattagataatttaattaatgatgcttctgaaatattgctcacatatgtctatctgggaaaatccattcttgggactcagggtacacatggaagaatcatctcaacatggaacaccctcacgagaacgcttagcatgcctggtaccttccaaaacgtcgaccgggacatcttgaacaaactgctcccaccatctcctatacatgggtttggaggtccattcttgtatttcaaatttgcacaaacgtcctgcgagatacatcactgctactgctatgatctctggttcccactgcagtgacaaggtggtgcagagactagttcaacaagaaaaaaaaaggttagataatatgatctaatatttatgattaaaccagtgcatggagatgccataactaaccattaatttgcttattctcccctaaatttaattaaagtactataaataaataaactcaagtctttactcttctaaaggtacccgactaagttactttaaccatagttagtaatttctctattccttaaagaatcagaagaattctagcacatccaaaaattgctacaccaatgaaaatgacttatgttatttaaactgttgaaatcctagccactcaactgtttcttcaaatgaaatcttatggaggaagtcaaatgtaagagaagcttcactgactgcagtgggatggggctggcagcaactccattcacaggcattctgtttcccaccacggcccctcattagatccctggcctctcaaaagagtgttaaggctctaaaactataccaggaagtatatttttgcaaaaccaaatgggctctaagtaattagttttcaaaattctccagtgtattgttttggacttatgtttcagactggtgataaaatttcagcacctcacaacaccatgacacggcagggcagaaggaaaccctctgccgggaagcagatgacctggacgtcagccccagctttgccattaactggctcctcaagccagggcaagtcagtttcttctgacacaaaatgaggggtttagatgaaatggtccataaagtctctgcctattttaaaatactgtaattaatcaacatttgaacatgtatacctgtcatttacaaatgtccatgccatttgaaccaacttttgaattttgtttttatcacctagaaatggggacaaaaaggtaaattaatagcaatagaaaaattcacaggcagcatcaagtatttattaaaaacctaccacgtgttcagcaccactcaaatacacagcaaagagcttttgcgtgggaaacaaggatgaatgatgtgggtccacatcctaccccttcttcctcctcatgacctacgctgaaccaccatgtatggaaaacctggctccaaggctaagtttattagtccatttaaaaaattctgcctcattttcctgcctctcccatcacttggcaactggatgacagagcctgtttatacataaaaggaaacagcattagcagctgcaatgctgaattgactgagcaagccatgcccttggtatttcacacatcaaactttgttttccgcttttgagaagcgtaatttgagtgtcatcaaattataaagacttgatttcagaatgaaaaaattcttctgaaaactttcttcttacctttgagttgctttgcatattttagtaggaactggtatggatgttctacctgtaaatcaaacttgatggtctgcagtaagattctctccagaaccattacttcctcctaaaaatcaatcacaaatgttaggacagtaattacaattgcaggtctcaagcagcattacaaaagtgagctttcctgtctatttattctctcttcaagttatattttagcaactgcctttccttcctttctctcccactcagacttttaacatgctcagagacactgataaattctgaaaagatctcaaacaggaagacaaagcagaggtgtaatgtaaaaaaaaatactgaaaacaaaagatccttaaaaatattattattttcaatacatacatgagtctccctttacaaaacagatctttacgttattgataatttgactaaattgtaatttctttcaagacctcaaattttaaaaatgcaatcttttaggaattttcattgaaaacattttaagcaagaaagagtttatgatagccagcctcatgaaaactcagagataaattgtaccagtgtgtgtgtatgtgtgtgtatatatactcatgtacacatatagtgtattacgtgcaaatgggggcaaatcaattttgtgtttaaatctttcatttatttgaaataaatcatcccaacaacacttactgaat

SEQ ID NO: 121202 - DNA, 930 bp, Homo sapiens
  Payload ID: 3764
  Gene Symbol: CCDC85C
  Gene Name: coiled-coil domain containing 85C
  ENST ID: ENST00000555822
  CDS Start-End: 577-771
attcattctggctcctggtcccagccccagccccaaattctgggggtcggtggtgtttgctttgctcttaagcaaagggtctaaggccaagccttcctccctccctcctgtgtgcaggagttagttacaaccccacagcttgcacgagttctcagggattcagaggcagcacccaggacctgctttaggagctccctgcccatccgatgggggaggcagcctgggcggagcatcccgagagagccccgaacccgtgggaggtgggaggcctcgcctgtggatgtggccccatctgctgccgatggctggcccaggccctgtgagtggtgccgtctgtgcagggacccaagggcaggaagttggagcggaggagccaggcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtc

SEQ ID NO: 121203 - DNA, 3793 bp, Homo sapiens
  Payload ID: 3764
  Gene Symbol: CCDC85C
  Gene Name: coiled-coil domain containing 85C
  ENST ID: ENST00000557769
  CDS Start-End: 385-579
gtcacggggtgggagagacactctctcctcactcgctctcactggctcttcttcattcattcattcattctgtttattcagccatccaacaaatgtttacaaagcccacgttggagagtggatcgctgacatttgagctggggagagtgaagatcgattgatcccggctcgggggatggataagcgcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacagggattttgatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcatgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctg

SEQ ID NO: 121204 - DNA, 619 bp, Homo sapiens
  Payload ID: 3764
  Gene Symbol: CCDC85C
  Gene Name: coiled-coil domain containing 85C
  ENST ID: ENST00000554996
  CDS Start-End: 1-573
agcagctccagccactttgctgaccgaattcctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccag

SEQ ID NO: 121205 - DNA, 556 bp, Homo sapiens
  Payload ID: 3764
  Gene Symbol: CCDC85C
  Gene Name: coiled-coil domain containing 85C
  ENST ID: ENST00000556348
  CDS Start-End: 208-556
gctgccatcctatcttgtaggaggcgaaggcagggctcagagctaagagaaggcgctgcctcaggtccgtgcctcccaccctgcctgggacttgggcagacattccttccttagccgtttactgagcacctgttgcacaccaggccccgtttccatgctcctgggatacttccatgaagcaagacagacagaagtctcctttggaagatggataaactggcaaacaaatccatggatgggacagtttcatatcctgatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatc

SEQ ID NO: 121206 - DNA, 543 bp, Homo sapiens
  Payload ID: 3764
  Gene Symbol: CCDC85C
  Gene Name: coiled-coil domain containing 85C
  ENST ID: ENST00000554877
  CDS Start-End: 403-543
atccctgtgtggactccctgggcctcacaggttctcagctaagctgctggaccagcgaggcaggtcccactggtgtggttcatgagaagtgcgtggacagcaccatcctgtgctgggaggtgacagacagatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctcc

SEQ ID NO: 121207 - DNA, 656 bp, Homo sapiens
  Payload ID: 3764
  Gene Symbol: CCDC85C
  Gene Name: coiled-coil domain containing 85C
  ENST ID: ENST00000557576
  CDS Start-End: 1-371
atccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacgtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctcc

SEQ ID NO: 121208 - DNA, 1893 bp, Homo sapiens
  Payload ID: 3765
  Gene Symbol: CCDC86
  Gene Name: coiled-coil domain containing 86
  Uniprot ID: Q9H6F5
  ENST ID: ENST00000227520
  CDS Start-End: 55-1137
ggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcgggaagagattcagctcccatccctccttcctctccttctccaagtgccttcaaaccaagaactgtacattcttctggttcctcagtgagctggtgactggcaggtgactccctcagcagtgtatgccctttctcagcatcctaggtccatcccaggcctggaggctgacagttgggaatccagcttcccccacaccttcccaaaggctgctctgagcacctccacaccccactgcctctgtccccagcagactgaatccggttcctctccacttttcaatactgaaagattaaaatggggaggttgcagggagcagagcttttccctagcacccactttcccaaaccagtctctgcagaagccccagagaatctaactcatgcctgtccagtctacagcaaaaatatttattgagtgcctgttgcatacaggcacaatcctaggcaccggcaaatacagacaatagaccaaagtccctgccctcgaggagctttcattctgatggagagaaaacataataaacaagcaaaatgca

SEQ ID NO: 121209 - DNA, 697 bp, Homo sapiens
  Payload ID: 3765
  Gene Symbol: CCDC86
  Gene Name: coiled-coil domain containing 86
  Uniprot ID: Q9H6F5
  ENST ID: ENST00000545580
  CDS Start-End: 162-476
ggccacctccctagggggtgagcgccccgcctccagaggcattcacacccgggccaaatgcacttggcggaagcaacagaactttacagcaggggccgcgtagcctggactctgcagtcgctgacaggattcaagtcctgactgccacaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcg

SEQ ID NO: 121210 - DNA, 1488 bp, Homo sapiens
  Payload ID: 3765
  Gene Symbol: CCDC86
  Gene Name: coiled-coil domain containing 86
  ENST ID: ENST00000535217
  CDS Start-End: 1-265
cagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagccatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcgggaagagattcagctcccatccctccttcctctccttctccaagtgccttcaaaccaagaactgtacattcttctggttcctcagtgagctggtgactggcaggtgactccctcagcagtgtatgccctttctcagcatcctaggtccatcccaggcctggaggctgacagttgggaatccagcttcccccacaccttcccaaaggctgctctgagcacctccacaccccactgcctctgtccccagcagactgaatccggttcctctccacttttcaatactgaaagattaaaatggggaggttgcagggagcagagcttttccctagcacccactttcccaaaccagtctctgcagaagccccagagaatctaactcatgcctgtccagtctacagcaaaaatatttattgagtgcctgttgcatacaggcacaatcctaggcaccggcaaatacagacaatagaccaaagtccctgccctcgaggagctttcattct

SEQ ID NO: 121211 - DNA, 2908 bp, Homo sapiens
  Payload ID: 3766
  Gene Symbol: CCDC87
  Gene Name: coiled-coil domain containing 87
  Uniprot ID: Q9NVE4
  ENST ID: ENST00000333861
  CDS Start-End: 69-2618
gtcgggctcctggttgccttagtaacccctcggctttctgttcctggacggtggcggccgccggctctatgatggagcccccgaagcccgagcctgagctccagcggttttaccaccggctgctgcgtccgctgtcgctcttccccactaggacgacgtccccagagcctcagaagcgccccccgcaggagggccggattctgcagtccttccctctggcgaagctgacggtggcgtcgctgtgcagccaggtggccaagctgctggccggcagcgggatagcagcgggagtgcctcctgaggcccgactacgtctcatcaaggtcatcctggacgagctgaagtgcagctggcgggagccgcccgccgaacttagtctgagccacaaaaacaaccagaagctgcggaagcggctcgaggcctacgtgctgctgagcagcgagcagctcttcttgcgctacctgcacctgctggtgaccatgtcgactcccaggggggtcttcactgaatcagccaccctcacccggttggccgccagcctcgccagggactgcacactcttccttactagtcccaacgtctaccgtggcctgcttgccgacttccaggccctgctgagggcagagcaggcctctggggatgtggacaagctgcaccctgtctgccccgctgggacgttcaagctgtgccctatcccctggcctcacagcactggcttcgcccaagtgcagtgctctaacctcaacctgaactacctcatccaactcagccgtccaccagagtttctcaatgagccaggaaggatggatccagtgaaggaattgaagtccatccctcggttgaagaggaaaaagcctttccactggctgccctccataggaaagaagagagaaatcgacatcagttcctcacagatggtgtcgctgcccagctatcctgtggcccccaccagcagggcttccccctcgcctttctgccctgagctccggagaggccaatccatgccctccctgcgtgagggctggaggctggcagatgagttgggccttcctccactcccatctcgccccttaaccccgctggtcttggctacagagagcaaaccagagctgactgggctcatcgtggctgaggatctgaagcagttgataaagaagatgaagttggaggggactcgctacccaccactggactcaggcctgcctcctctcctgggggttgtgacccgtcacccagctgcagggcatcgcctggaggagctggagaagatgttgaggaacctccaggaggaagaagcctctgggcagtgggacccccagccccccaaatcctttccacttcacccacagccagtgaccattactttgaagcttagaaatgaggtcgtggtccaggcggctgccgtacgggtctctgatagaaacttcttagactctttccacattgagggggccggagccctgtataaccatctggctggtgaactggatcccaaagccattgaaaaaatggatattgataactttgttggcagtactaccagggaggtctacaaggagttgatgagccatgtctcttctgaccacttacattttgatcaagggcccctagttgagcctgcagcagataaagactggtcgaccttcctgtcctcagcctttctacgtcaagaaaaacagcctcaaatcatcaaccctgagctggttggactttactcccagagagcaaacactttacagtccaatactaagaagatgccctccctcccatcactccaagctaccaaaagctgggagaagtggtcaaacaaggcctccttgatgaactcatggaaaaccaccttgtctgtggatgactacttcaagtacctcaccaaccatgaaacagatttccttcatgtcatctttcaaatgcatgaagaagaggttcctgtggagattgtggcccctgccagagagtccctagagattcagcaccctcccccattgctagaagatgaagaaccagactttgtgccaggagagtgggattggaacactgtgctagagcacaggctaggagctgggaagacaccccacctgggagaaccccacaaaattctgagcctgcagaagcatctggaacaactgtggtctgtgcttgaggtccctgacaaggaccaggtggacatgaccattaaatatagctccaaagcccgcctgaggcagctgccttcattggtgaatgcctgggagcgggccctgaagcccattcagctgcgggaggcattgctggcgagactagagtggtttgagggacaagcttccaatcccaaccgcttcttcaaaaagaccaacttgagctccagtcacttcctggaggagaatcaggtccgaagccatctccacaggaagctcaacttaatggagtcttctttggtttccctcctggaggagatagagttaatctttggcgagccagtgatcttcaaggggcggccctacctggacaagatgaagagtgacaaagtggagatgctctattggctgcaacagcagcggcgggttcgccacctggtctcggccctgaaggatccccaccagtcaaccctgttcaggagctcagcagccagcctttagtagctcctgggaatacccctattactccttgaccaggcccagtgccctcaaatgcctccctcacccctaaatggccagcagctcatctagacctctttactgctttggaagaagaaatatttgtctatatctgggagtggagggttcaggaacattatgcttccaactatgaagggattgagactaaaactattgttttcttagtgaaattctcatgaaagaatccccaagcctagtagtcccattatgtcaagccttgcacaatacaagccaaatctcctatatcaaaa

SEQ ID NO: 121212 - DNA, 9667 bp, Homo sapiens
  Payload ID: 3767
  Gene Symbol: CCDC88A
  Gene Name: coiled-coil domain containing 88A
  Uniprot ID: Q3V6T2
  ENST ID: ENST00000263630
  CDS Start-End: 778-6309
gttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 121213 - DNA, 9505 bp, Homo sapiens
  Payload ID: 3767
  Gene Symbol: CCDC88A
  Gene Name: coiled-coil domain containing 88A
  Uniprot ID: Q3V6T2
  ENST ID: ENST00000336838
  CDS Start-End: 535-6147
cgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 121214 - DNA, 2880 bp, Homo sapiens
  Payload ID: 3767
  Gene Symbol: CCDC88A
  Gene Name: coiled-coil domain containing 88A
  ENST ID: ENST00000412148
  CDS Start-End: 1-2667
cttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaatttta

SEQ ID NO: 121215 - DNA, 582 bp, Homo sapiens
  Payload ID: 3767
  Gene Symbol: CCDC88A
  Gene Name: coiled-coil domain containing 88A
  ENST ID: ENST00000430086
  CDS Start-End: 141-582
attctatgcagagatagctttatcaaatgtgcttcagctaagtaacaatccaacacaattattaatatttttccctcagtaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccatt

SEQ ID NO: 121216 - DNA, 9586 bp, Homo sapiens
  Payload ID: 3767
  Gene Symbol: CCDC88A
  Gene Name: coiled-coil domain containing 88A
  Uniprot ID: Q3V6T2
  ENST ID: ENST00000413716
  CDS Start-End: 843-6233
attggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgt

SEQ ID NO: 121217 - DNA, 4500 bp, Homo sapiens
  Payload ID: 3767
  Gene Symbol: CCDC88A
  Gene Name: coiled-coil domain containing 88A
  ENST ID: ENST00000426576
  CDS Start-End: 1-3609
caactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctagtgagtaccatttacaccagtggtcctctcatatacttgacatcccaacacatactataggttcttgtgcccaaaatgatttagctatagacatgcctgagcctctatatgcccaggctagaaactcaagaacaggaaggtcacattttctaaaccaaacttttgccactattaggatgcctagtgatgcattcggaatgttggcaaaagatagcataggaccatttactgtggcccattcatctcagccattcttatccctgaatacagaattagttagtaacataagtgggttacctcctaggccagttatcagaataactgaccaggcttctgcctctttggataaacctgcacagaaagaaaatgaacagttttctgatcatcagaaccctagtaacagtaacctacagttttctataaatagcaacaatcttgtcacttctgcatgcctctatcctgatgacacagaagctgcattgttggtttctgaggataatcaaactgtttggtatgaatatggttgtatatgatcaaaactgcacaatataatatattgatgttatttgatatacactgcttctctaatatgatttgaaaagttgctgttaacaaaatatcatttggctaggtttttattttttatttaaaattgttgcacagtgttcagctgtacatgatggcatgtatattaatgtgaatgtgtaaccacaccaaaacctgcatgaaatattaattactttgtccattttctgcatgcctttaaaaaccttaaccatacatgctcctccttcacattttttgttgcctgataagattgttactttgatatccagaagcatgttaaaacagttgcatgctctcttaccaagaagacatttccaagtcatatttgctttgttgcttctggaaaaaaatgttcatttcctccctcccttcctcctcttcccacccctcacttgctctgactgtcactcctttttttcttccagaatgtgtactttatattacatatgtacagtatcagtagggaaaatgtaaaaagatgttgttttcttttgtcatttaattaggccatctgtcctgttttaaagaaatagttaataattcaacactttatataacaaatattaactaatacccatatttataaaacatttttcagatttaaaagattgttaatacttataaacttagtgttattcttagaaaaccccatcaaatttaaatgtgatttacacagtgactaggaacatttgtatttattgtttcttctctgcacttttcatcatctgataaatacaagagctcaagtaactgtcttttcttcaagatggcttctatacttgaaatcagttaatacaatagtttttccagttctttttttatagagagtcaaagagaaataaaccaaattatattca

SEQ ID NO: 121218 - DNA, 9811 bp, Homo sapiens
  Payload ID: 3767
  Gene Symbol: CCDC88A
  Gene Name: coiled-coil domain containing 88A
  Uniprot ID: Q3V6T2
  ENST ID: ENST00000436346
  CDS Start-End: 843-6458
attggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgt

SEQ ID NO: 121219 - DNA, 4236 bp, Homo sapiens
  Payload ID: 3767
  Gene Symbol: CCDC88A
  Gene Name: coiled-coil domain containing 88A
  ENST ID: ENST00000444458
  CDS Start-End: 1-1124
aaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaatactacatcctttgaagacataagtccacaaggtgttagtgatgattctagtacgggatcaagagttcatgcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatat

SEQ ID NO: 121220 - DNA, 2208 bp, Homo sapiens
  Payload ID: 3767
  Gene Symbol: CCDC88A
  Gene Name: coiled-coil domain containing 88A
  ENST ID: ENST00000456975
  CDS Start-End: 1-2208
taagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagt

SEQ ID NO: 121221 - DNA, 3089 bp, Homo sapiens
  Payload ID: 3767
  Gene Symbol: CCDC88A
  Gene Name: coiled-coil domain containing 88A
  ENST ID: ENST00000621814
  CDS Start-End: 760-2985
cgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaagaaaataaatcattagagcaagagacttctcaactggaaaaggataagaaacaattggagaaggaaaataagagactccgacaacaagcagaaattaaagataccacattag

SEQ ID NO: 121222 - DNA, 870 bp, Homo sapiens
  Payload ID: 3768
  Gene Symbol: CCDC88B
  Gene Name: coiled-coil domain containing 88B
  Uniprot ID: A6NC98
  ENST ID: ENST00000301897
  CDS Start-End: 12-431
ggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctg

SEQ ID NO: 121223 - DNA, 4915 bp, Homo sapiens
  Payload ID: 3768
  Gene Symbol: CCDC88B
  Gene Name: coiled-coil domain containing 88B
  Uniprot ID: A6NC98
  ENST ID: ENST00000356786
  CDS Start-End: 45-4475
ggcaggtgcagctgccacagtgagacgggcaccccgacccgggcatggaggggggcaaggggcccaggctcagagacttcctgagtgggagtctggctacctgggcgctgggactggccgggctggtcggggaggcggaggactcggagggggaagaagaggaagaggaggaagagccgcccctttggttggagaagagattcctgcgcctcagcgatggggccctgctcctccgggtgctgggcatcattgcccccagctcccgagggggacctcggatgctcagaggccttgacggacctgctgcctggcgagtgtggaacctgaaccacctgtggggccgactgagggacttctaccaggaggagctgcagctgctgatcctgtcgccacccccagacctccagacattgggatttgaccctctctcagaagaagcggtggagcagctggaaggcgttcttcggctactgttgggagcgtcagtacagtgtgagcaccgggaactcttcatccgccacatccagggcctcagtctcgaggtccagagcgagctggccgctgccatccaggaggtgacccagccgggggccggcgtggtgctggcactgtctgggccagatcctggggagctggcacctgccgagctggagatgctgtcccggagcctgatggggacactgtcgaagctggcacgggagcgtgacctgggggcccagcggctggctgaactgctgctggagcgagaacccctctgcttgaggcctgaggctccctctagggctcccgccgagggcccctcgcaccatctggccctgcagctggccaacgccaaggctcagctgcggcgtctgcggcaggagctggaggagaaggccgagctgctgctagactcccaggccgaggtgcagggtttggaggccgaaataagaaggctccgccaggaggcccaggcgctgtcgggacaggccaagcgggccgagctgtaccgcgaggaggcagaggcgctgcgggagcgggccggccgcctgccccgcctgcaggaggagctgaggcgctgccgcgagcggctgcaggcggctgaggcctacaagagtcagctggaggaggagcgggtgctctcgggggtgctggaggcgtccaaggcgctgctggaagagcagctggaggctgcccgagagcgctgcgcccggctgcacgagacccagcgcgagaacctgctgctgcgaacccggctgggcgaggcccatgcggagctggactctctgcggcatcaggtggaccagctggctgaggagaatgtggagctggagctggagcttcagcggagcttggagccacctccaggatcccctggggaggcacccctagcaggagcggccccctcgctgcaagatgaggtgagggaggcagaggctgggcggcttcggacccttgagagggagaaccgggagcttcgggggctgcttcaggtgcttcaggggcagccagggggccagcaccccctgctggaggcaccgagagaggaccctgttcttccagtgctggaggaggctccccagactcctgtggccttcgaccacagccctcagggcttggttcagaaggcaagggatggaggcccccaggccttggacttggctcccccggcattagactcagtgctcgaggcatcagctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacagttgaggagaaaggctgaggcccttggagatgagctggaagcccaggcccgcaagctggaggcccaaaacacggaggctgcccgcctctccaaggagctggcccaagcgcgaagggcagaggccgaggcccaccgggaggcagaggcccaggcctgggagcaagcccggctgcgggaggcagtggaggctgctggccaggagctggagtctgcgtcccaggaacgggaggcgctggtggaggcgctggcagcagcgggccgggagcggaggcagtgggagcgtgaggggtccaggctgcgggcccagtcggaggccgccgaggaacggatgcaggtgctggagagcgagggccgccagcacttggaggaggctgagagggagcgccgggagaaggaggccctccaggcggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaaggtgaagaggctgatgcggccccggcgggaggggggcccccctggggggctgcgcctgggggccgatggggctggcagcaccgagagcctggggggccccccggagacggagcttcctgagggcagggaggcagatgggacagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 121224 - DNA, 2326 bp, Homo sapiens
  Payload ID: 3768
  Gene Symbol: CCDC88B
  Gene Name: coiled-coil domain containing 88B
  ENST ID: ENST00000359902
  CDS Start-End: 151-2289
ctggcagcatcctggcgccccctgcccccccagcccccactgtcagctcctgacttcctgtccctccagccctccgtggccttttccctgtagccaaggtctctcacccgacccacctctgctgagcctctctagctgtctcgctgtcacatggctggggtggcagcccaccgggcgcatccacctttcactgcgcacatgaagaaccgtgggctcagagaggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgca

SEQ ID NO: 121225 - DNA, 3104 bp, Homo sapiens
  Payload ID: 3769
  Gene Symbol: CCDC88C
  Gene Name: coiled-coil domain containing 88C
  ENST ID: ENST00000331194
  CDS Start-End: 284-1804
tccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 121226 - DNA, 1641 bp, Homo sapiens
  Payload ID: 3769
  Gene Symbol: CCDC88C
  Gene Name: coiled-coil domain containing 88C
  ENST ID: ENST00000389856
  CDS Start-End: 151-417
ctgcctcggggcggaccgggtcccagtggtcactcctgtccctggggtttagccactcccgaaaaggaccccattcttcccaaccaaatatctcatgtagtttttctgaatccctgagaccagccggtggatggcggtgacgggtggggaatggggggcgccgaatgggaaagcgaacagactggggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggactttacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggattctggcaatatcataaatattagtaaaaatagcatgttcccaatgatgacttacagcactatgccttttaaaaataaagttaaaagcaactacaatgactgtactctctaggaaaatttacaggtgcaataaaactacataaaaaaga

SEQ ID NO: 121227 - DNA, 7474 bp, Homo sapiens
  Payload ID: 3769
  Gene Symbol: CCDC88C
  Gene Name: coiled-coil domain containing 88C
  Uniprot ID: Q9P219
  ENST ID: ENST00000389857
  CDS Start-End: 88-6174
tgctcgctgcggagccgttttgtgccgcggcgcgggggaacggggacgcggggcggggggcgcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 121228 - DNA, 1651 bp, Homo sapiens
  Payload ID: 3769
  Gene Symbol: CCDC88C
  Gene Name: coiled-coil domain containing 88C
  ENST ID: ENST00000553403
  CDS Start-End: 155-445
gcggaacgtgggctcgcgcgccccgcctttgtctcccgggcgcgagccgccgcagccccgcgcccgctgctcgctgcggagccgttttgtgccgcggcgcgggggaacggggacgcggggcggggggcgcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggactttacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggattctggcaatatcataaatattagtaaaaatagcatgttcccaatgatgacttacagcactatgccttttaaaaataaagttaaaagcaactacaatgactgtactctctaggaaaatttacaggtgcaat

SEQ ID NO: 121229 - DNA, 3617 bp, Homo sapiens
  Payload ID: 3769
  Gene Symbol: CCDC88C
  Gene Name: coiled-coil domain containing 88C
  ENST ID: ENST00000556726
  CDS Start-End: 1-394
gattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 121230 - DNA, 1412 bp, Homo sapiens
  Payload ID: 3770
  Gene Symbol: CCDC89
  Gene Name: coiled-coil domain containing 89
  Uniprot ID: Q8N998
  ENST ID: ENST00000316398
  CDS Start-End: 148-1272
gttacttcatagcattctgaagacctgtccaccaattacagggctccttactggaaaaaccaactgctggggagtgccaagagtccctagcaacaccctgcagcgtttgaaatctgaggggaaaagactgtagtcagcccttagtggatgagagcgcctatgctccagaaacagcaggctcccaggatggacaccccgccccctgaagaacgcttagagaagcaaaatgaaaaactgaacaaccaggaagaggagacggagtttaaggaactggacggtctgagggaagccttggcaaacctccggggactgtcagaggaggagaggagcgagaaggctatgcttcgctcccgcattgaagagcagtcccagctcatctgcatcctgaagcggaggtcagatgaggccctggagcgctgccagatcctagagctgctcaatgcagagctggaggagaagatgatgcaggaggctgagaagctcaaggcccagggtgagtacagtcggaaactagaggaacgctttatgaccctagcagccaaccacgagttgatgctccgcttcaaggatgaatacaagagtgagaacatcaagctgagggaggagaatgagaagctgaggctggagaatagcagcctcttcagccaggctctgaaggatgaggaggcgaaagtattacagctcacagtccggtgtgaggccctcactggggagctagaaacgctgaaggagaggtgtgctcaggatgcctgccaggcacaggcgcgcgagaaggagctgctggagctacagagccagcaggcctgcacccacaccaaggagacagaacagctgcgcagccagctgcagaccctcaagcagcagcaccagcaggctgtggagcagatagctaaggcagaggagacacacagcagcctgagccaggagctgcaggccaggctgcagaccgtcactagagagaaagaggagttgctgcagctgtccattgaaaggggcaaagtgcttcagaacaaacaggcagagatctgccagcttgaggaaaagttggagatagcaaatgaagacaggaagcatgcgctggagcggtttgagcaagaggcagtggctgtggacagcaacttgagagtcagggagcttcagcgcaaagtagatgggatccagaaggcctacgatgaactcaggctgcagtctgaagccttcaaaaagcacagcttggatcttttaagcaaggagagagaactcaatggcaaactccgccatctctctccatagggaagtttctgcttcctctggcctgcaattcagaattcaaatatttgcgtcttagcattatggcaagagtaaagatgatatcccatttattatactttcaagcacaaaaggcaactcaaagaaaagctactttactatga

SEQ ID NO: 121231 - DNA, 2093 bp, Homo sapiens
  Payload ID: 3771
  Gene Symbol: CCDC9
  Gene Name: coiled-coil domain containing 9
  Uniprot ID: Q9Y3X0
  ENST ID: ENST00000221922
  CDS Start-End: 223-1818
tcccggaaacggtcccacaggaccggaagtgaccctctttatttcccttcctcacgtggtgcaggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgtgcgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctccaa

SEQ ID NO: 121232 - DNA, 834 bp, Homo sapiens
  Payload ID: 3771
  Gene Symbol: CCDC9
  Gene Name: coiled-coil domain containing 9
  ENST ID: ENST00000599398
  CDS Start-End: 450-834
cccagccggattgaggctggagctttgcacagaaaatctggggcgggcctgggtagttttgtccttgttggggcgggtggagtattcagtggggcaaaacgccagttccaggaagcctcgccagtgagttctgggcctgtgtacagaatcctttcgggggaggcgggaggctgtcgaccttccgtagggcgctggagacgggactaggacgtccctgaggaaggcgcgggcttggaatgttctctgagagcttgggcagccaataagagtggggttcggactttctttgagcgtgggattgggaatgtttctgaaccttacctggtggagctagaatattcgcctggatatgagaggcaccaggatgagcacagggaggaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtg

SEQ ID NO: 121233 - DNA, 356 bp, Homo sapiens
  Payload ID: 3771
  Gene Symbol: CCDC9
  Gene Name: coiled-coil domain containing 9
  ENST ID: ENST00000595659
  CDS Start-End: 187-356
gattgaggctggagctttgcacagaaaatctggggcgggcctgggtagttttgtccttgttggggcgggtggagtattcagtggggcaaaacgccagttccaggaagcctcgccagaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaa

SEQ ID NO: 121234 - DNA, 457 bp, Homo sapiens
  Payload ID: 3771
  Gene Symbol: CCDC9
  Gene Name: coiled-coil domain containing 9
  ENST ID: ENST00000596938
  CDS Start-End: 313-457
gtgggtttgactagatcgtttacatgggaactgggtgagtccacaaagatcatgaaagggctgagtctgaatttctatggagaagatggaggtggcagttgaaaggagggagagtgagggctacaattctcttggggtacagggttttttgtgtatggctgtgaggatcccgcagtatgttagagggtgaagtaggttggggggccattggcctttgtcctttttttccctctgtccccaggaaccctcagtgctgcgtctagattctgcaggggaggtttgctgggaccttggctccacgcagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagg

SEQ ID NO: 121235 - DNA, 1688 bp, Homo sapiens
  Payload ID: 3772
  Gene Symbol: CCDC90B
  Gene Name: coiled-coil domain containing 90B
  ENST ID: ENST00000260054
  CDS Start-End: 383-871
tctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatggtaagtgaattttttttctagctgttaatttcagaacaaatattcgttacaagatcattttttaaatatctttgctttctttaaagcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaa

SEQ ID NO: 121236 - DNA, 1550 bp, Homo sapiens
  Payload ID: 3772
  Gene Symbol: CCDC90B
  Gene Name: coiled-coil domain containing 90B
  Uniprot ID: Q9GZT6
  ENST ID: ENST00000455220
  CDS Start-End: 219-956
aggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaagttgtgtgggttttcaaagtgacttaccatatagttggagattgatttctttttggtaatgaactaaaacaataaattttaaaatgataggccaggcgcggtggctcacacctgtaatctcagcactttgggaggctga

SEQ ID NO: 121237 - DNA, 1986 bp, Homo sapiens
  Payload ID: 3772
  Gene Symbol: CCDC90B
  Gene Name: coiled-coil domain containing 90B
  Uniprot ID: Q9GZT6
  ENST ID: ENST00000529611
  CDS Start-End: 1076-1537
ccctcccaccggaaaactctgaggacatgaatagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggtaatctgtgtttgagggtgtcctgttttcttttgtggcctgatcaaattttgattttgtttttttaggtgctggcctcgagcccaggtttttggtagacagcatcataaatttcaggccacgtctgccttattctcactggaattctcagtacatttcagtcacattgtagactttgggaaaataagtgaatactggaacccacaagtttccaacctgttggcacccctgttaacagggtgtcctgaagacatctaactttattcagagaaatgtttctagggctaggtttttgttgtcgtcgttgtttttcacccccagttttttaacttccctcccagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattac

SEQ ID NO: 121238 - DNA, 1919 bp, Homo sapiens
  Payload ID: 3772
  Gene Symbol: CCDC90B
  Gene Name: coiled-coil domain containing 90B
  Uniprot ID: Q9GZT6
  ENST ID: ENST00000525503
  CDS Start-End: 1003-1464
cccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaa

SEQ ID NO: 121239 - DNA, 719 bp, Homo sapiens
  Payload ID: 3772
  Gene Symbol: CCDC90B
  Gene Name: coiled-coil domain containing 90B
  ENST ID: ENST00000529073
  CDS Start-End: 7-633
gaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgactttttttttaacttcctgctgcttcatatcctatagtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattt

SEQ ID NO: 121240 - DNA, 773 bp, Homo sapiens
  Payload ID: 3772
  Gene Symbol: CCDC90B
  Gene Name: coiled-coil domain containing 90B
  ENST ID: ENST00000529312
  CDS Start-End: 8-124
tgaggacatgaatagtcgccaggcttggcggctctttctctcccaaggcagaggagatcgttgggtttcaaggccccgcgggcatttctcgccggccctgcggagagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctg

SEQ ID NO: 121241 - DNA, 723 bp, Homo sapiens
  Payload ID: 3772
  Gene Symbol: CCDC90B
  Gene Name: coiled-coil domain containing 90B
  ENST ID: ENST00000534753
  CDS Start-End: 17-370
ggaaaactctgaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggttatttttattttgttttctaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaa

SEQ ID NO: 121242 - DNA, 1433 bp, Homo sapiens
  Payload ID: 3772
  Gene Symbol: CCDC90B
  Gene Name: coiled-coil domain containing 90B
  ENST ID: ENST00000526265
  CDS Start-End: 17-190
ggaaaactctgaggacatgaatagtcgccaggcttggcggctctttctctcccaaggcagaggagatcgttgggtttcaaggccccgcgggcatttctcgccggccctgcggagaggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacatactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttgctcataagaattattttctgaatacagtggcttactagtttcttttgaagatttttttccttatcaattctgtattagaaatccatagattgtccaaattttggtaatctagggtttcagatttttttaatcataatatagacttggtttaatgctaattgcatgtgatctttcctgtacctagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggtaaagtaatatgtaaaaatgtctcttttgtacagttcttgtgccttgtataactgcttttatgtgtaccagtttataagtttagacttttaaaaactacccttgtagagtctctggcttcctcatagctattatagttaaccagcacttttggggaacctggcaccaggtagatggtcgcccatgagccatgaccttgaagtaagaatcaagatttccacatagtgtgcttttttaaactaaattacttctataatagaaaataactattttttgggccaggcacagtagctcacacctgttaatcctgcactttgggaggctgaggcaggagttcaagaccagtctgggcaacatagcaagaccctgtctcaaaaacaaaaaaaaaaaaaagaaaataa

SEQ ID NO: 121243 - DNA, 1587 bp, Homo sapiens
  Payload ID: 3772
  Gene Symbol: CCDC90B
  Gene Name: coiled-coil domain containing 90B
  ENST ID: ENST00000533761
  CDS Start-End: 1-286
tcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacatactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttgctcataagaattattttctgaatacagtggcttactagtttcttttgaagatttttttccttatcaattctgtattagaaatccatagattgtccaaattttggtaatctagggtttcagatttttttaatcataatatagacttggtttaatgctaattgcatgtgatctttcctgtacctagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaagttttccttctaacagtcaggaccctcagctgcaggtctgttggagtttgctggaggtccactccagaccctgtttacctgggtatcaccagcagaggctgcagaacagcaaatattgctgcctgatccttcctctggaagctttgtcccagaggtgcagccgcctatatgaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgt

SEQ ID NO: 121244 - DNA, 987 bp, Homo sapiens
  Payload ID: 3772
  Gene Symbol: CCDC90B
  Gene Name: coiled-coil domain containing 90B
  ENST ID: ENST00000528149
  CDS Start-End: 114-245
gagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttcct

SEQ ID NO: 121245 - DNA, 1039 bp, Homo sapiens
  Payload ID: 3772
  Gene Symbol: CCDC90B
  Gene Name: coiled-coil domain containing 90B
  ENST ID: ENST00000529856
  CDS Start-End: 384-557
atctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtg

SEQ ID NO: 121246 - DNA, 1053 bp, Homo sapiens
  Payload ID: 3772
  Gene Symbol: CCDC90B
  Gene Name: coiled-coil domain containing 90B
  ENST ID: ENST00000529745
  CDS Start-End: 239-532
gggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaaga

SEQ ID NO: 121247 - DNA, 4014 bp, Homo sapiens
  Payload ID: 3772
  Gene Symbol: CCDC90B
  Gene Name: coiled-coil domain containing 90B
  Uniprot ID: Q9GZT6
  ENST ID: ENST00000529689
  CDS Start-End: 436-1200
cagcggccgaaaacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaagttgtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgttacattctgattcatttttatctctattgcctaagagagttcttagtatattatagattaattttcactgagtcaattaataagttaccatatatattaaagtccactgtaacaaagtatactgcatttgttcagttaaccaatatgactgcctgctatatgccaaacagcatgctagtccctgtgtgcacagagatgaacatggtttcattctcattgaattgacaatcttaaggagagagacataaacaagtaaattattggtttgttaagatttaaaatattctaaaatattaagagggaatgcgtctttcctccatgtgaaggaagctccagtagcataacactgtcgtcactcttcatccccttatccactctgccctaggtaaagtgacttgcccaattgtaaatctggaaggagaaacaaggtgcaattagcccacttcctccccactcctgtttgggaccagcccatctgaagagacattcattctgttctgcttctatgggatcaggctctgcctctgcaggatgaggcctggcccagtagagcaatgcttgagacagggtaaatctgtccagttctagagttcagtgataagaagcttactggccttaagatgaaacccatattctcttgctgagcacagtggcacacatctatagtcctagctgcttgggaggctgcggcagcaggattgcttgagccaaggagttcatcaaggctaaagtgtaccatgatcatacctataaatagtcactgcactccagcctggcaacacatgagaccctgtctcctaaaaaaaaacttctccaatagttttatcagcaaataaaggtgttttttaggcctctatattagtttattcattcttcatcttagttatattcacaacccagaatggaaaggaggtatgccatttattggaccttctcaagccccaacaaataaatatacttattcccaggttatacagccactaaatattaaatagatctgcgttctttctcattgtaggggtttagcaaacaaagtgctttgtatccaataacagaagaatagaaatatgcataccataccctgtccccattacttttagatcctatatcctttccatgaaacttcattttgatggtggttctggggttcaggtaaatttttgtttcagtgatggaaatatatgaaataaggatgagaggattgtgtttctatatgccttaaaactatacctctattccagcacttgcacttcactatgaaacagcaattatacgtatctttttcctacactaaactacaagttctcagaaggcctctagacacatgtgaggtacttgttaaacgcctgtggaataaatgatactcataaa

SEQ ID NO: 121248 - DNA, 777 bp, Homo sapiens
  Payload ID: 3772
  Gene Symbol: CCDC90B
  Gene Name: coiled-coil domain containing 90B
  ENST ID: ENST00000527025
  CDS Start-End: 19-135
ccggaaaactctgaggacatgaatagtcgccaggcttggcggctctttctctcccaaggcagaggagatcgttgggtttcaaggccccgcgggcatttctcgccggccctgcggagagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatgga

SEQ ID NO: 121249 - DNA, 612 bp, Homo sapiens
  Payload ID: 3772
  Gene Symbol: CCDC90B
  Gene Name: coiled-coil domain containing 90B
  ENST ID: ENST00000527495
  CDS Start-End: 1-402
ggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgt

SEQ ID NO: 121250 - DNA, 2334 bp, Homo sapiens
  Payload ID: 3773
  Gene Symbol: CCDC91
  Gene Name: coiled-coil domain containing 91
  Uniprot ID: Q7Z6B0
  ENST ID: ENST00000381259
  CDS Start-End: 17-1342
aggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactt

SEQ ID NO: 121251 - DNA, 2738 bp, Homo sapiens
  Payload ID: 3773
  Gene Symbol: CCDC91
  Gene Name: coiled-coil domain containing 91
  Uniprot ID: Q7Z6B0
  ENST ID: ENST00000545336
  CDS Start-End: 420-1745
ttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggcttctaaccctcctttatgtgactcagagaaaggagacctcattccaagttccaggattaattctgatgaaagtattctgtctcatgcatctaatactttacttgtgaatgaagattcattatgaggtgctatacgtggatgacctgcttagttttaatttttggagaaatacattttataaaacattttcatcagattgctaaaattgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 121252 - DNA, 1626 bp, Homo sapiens
  Payload ID: 3773
  Gene Symbol: CCDC91
  Gene Name: coiled-coil domain containing 91
  ENST ID: ENST00000535520
  CDS Start-End: 197-364
aaaagcaactgagcaaggaggttggataggttgtgtggaggacagatgataactttgttttggaacacttcctccttcacaggctcatgctctctctctcacctgccgccatgtaagatgtgcctgcttctccttctgccatgattgtaagtttcctgaggcctccccagccgtgcaaacctgtgccacttgaagaatggatgatgatgattttggtggttttgaggctgcggagacttttgatggtggaagtggtgaaacccaaacaacatctcctgctattccttgggctgcctttcctgcagggaaacatgcaattttcattgtgagctgccttccagagtttatggtagaacttcactgaagttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaaccc

SEQ ID NO: 121253 - DNA, 259 bp, Homo sapiens
  Payload ID: 3773
  Gene Symbol: CCDC91
  Gene Name: coiled-coil domain containing 91
  ENST ID: ENST00000541792
  CDS Start-End: 1-141
ctcgatcaagtcatccgccaaagaagcctgtccagtttggaactgttcctctcctgtgcacagaaacaggatactgaggggctacttgtgagatggcaaaaaagagatatggcaaccagaatttccctcagtcgcccctgacaagttctcctacatcttcacacaaagagaagtctggcctaggaggtggaggatgcagcgcaccaagatcgcaccactgtactccaggatgggcaccagagtgagaccttgtctcaaa

SEQ ID NO: 121254 - DNA, 471 bp, Homo sapiens
  Payload ID: 3773
  Gene Symbol: CCDC91
  Gene Name: coiled-coil domain containing 91
  ENST ID: ENST00000538586
  CDS Start-End: 217-471
ctctcttgcctgcagccatgtaagttgtgcctttgcttctccttcaccttccaccatgattgtgaggcctccccagccatgtggaattttcctccttcacaggctcatgctctctctctcacctgccgccatgtaagatgtgcctgcttctccttctgccatgattgtaagtttcctgaggcctccccagccgtgcaaacctgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactatt

SEQ ID NO: 121255 - DNA, 2440 bp, Homo sapiens
  Payload ID: 3773
  Gene Symbol: CCDC91
  Gene Name: coiled-coil domain containing 91
  Uniprot ID: Q7Z6B0
  ENST ID: ENST00000539107
  CDS Start-End: 230-1447
ggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 121256 - DNA, 1667 bp, Homo sapiens
  Payload ID: 3773
  Gene Symbol: CCDC91
  Gene Name: coiled-coil domain containing 91
  ENST ID: ENST00000543809
  CDS Start-End: 90-893
gtgggaaaggattgttttcctgtaatgaagtccatcttgtattactgagtcaaggaaactataatcaacatttgggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagagtgcccttttttcaatccttcctgcgattggctgcttttagaatcctgctgattggtgcgttttacagagtgctgattggtgtattttacaatcctcttgtaagacaggaaagttccccaactccctactcgacccaggaagtccagctggcctcacctctcaattccaccaggaagaataaagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctga

SEQ ID NO: 121257 - DNA, 518 bp, Homo sapiens
  Payload ID: 3773
  Gene Symbol: CCDC91
  Gene Name: coiled-coil domain containing 91
  ENST ID: ENST00000540794
  CDS Start-End: 157-518
cagacagaagttaagtaagaggctttgggtcaagactgtgactggattcaaatcctaaagttttcgctacactgtgtgctgtggttcctccttcacaggctcatgctctctctctcacctgccgccatgtaagatgtgcctgcttctccttctgccatgattgtaagtttcctgaggcctccccagccgtgcaaacctgcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaaga

SEQ ID NO: 121258 - DNA, 502 bp, Homo sapiens
  Payload ID: 3773
  Gene Symbol: CCDC91
  Gene Name: coiled-coil domain containing 91
  ENST ID: ENST00000542801
  CDS Start-End: 1-368
aaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacaggatactgaggggctacttgtgagatggcaaaaaagagatatggcaaccagaatttccctcagtcgcccctgacaagttctcctacatcttcacacaaagtaagagggccgccacttcacggtgatctcagcactcctaatgccatttggaaaattctggacttggattaagcactactcaggcaggacagttcacagatatctgtg

SEQ ID NO: 121259 - DNA, 1578 bp, Homo sapiens
  Payload ID: 3773
  Gene Symbol: CCDC91
  Gene Name: coiled-coil domain containing 91
  ENST ID: ENST00000545737
  CDS Start-End: 492-1578
acagctcaaaaatgctgatcaattttgaaaatctaaatcagccttggccctgaaaccgagggaagaacctttgtggtaggggacagatttccaaaaactcaccacagtcctgttcttagctggagtttgtgctgatgttgccagacaactgaggaatagatgcaaaaagcaggaagcattattgaattgagctctagtgccaatttgggaaaagcaaattaaaatgtaaaagaatatttttccactcctggcatctcaacataaaatggcaaaatacatggttgctgaaaaagttacagaaattgctaattttgccaaaaagtaaaagccaattgcaaattcttttttgcataaaaaatgcatagacagttagaaattctaatttacaaataaatatgtatacatttaagttggagagtattttgacataaatgactgtgtgtgtgcgggcttgtttcaatatcttatatttttcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaa

SEQ ID NO: 121260 - DNA, 735 bp, Homo sapiens
  Payload ID: 3773
  Gene Symbol: CCDC91
  Gene Name: coiled-coil domain containing 91
  ENST ID: ENST00000542814
  CDS Start-End: 1-93
ctcgatcaagtcatccgccaaagaagcctgtccagtttggaactgttcctctcctgtgcacagaaacaaccacggttgaccacaggtaactgaaaccacaggaatgagatgacagggatactgaggggctacttgtgagatggcaaaaaagagatatggcaaccagaatttccctcagtcgcccctgacaagttctcctacatcttcacacaaagtaagagggccgccacttcacggtgatctcagcactcctaatgccatttggaaaattctggacttggattaagcactactcaggcaggacagttcacagatatctgtgagccatgacttaaggcccatcatctctgaagctatttccaagttagttagcatcatatggacaaacagagggagaggcagaaagagaaatttcttttcctgcaacgtatgtgttatgttaacaataggatacaatgaagttagggaatcatgtatgaatgtaaatgcccctgcatccccaccgtgttcagtactttatgtattacctttgtcttttccatgatatgcttcttacacattcccccactctttccatggttatctgtcaattgtcaaatgctgtttacctagagcatcggggttctcatttgctagacttttttttttttgcagtttattattctttacctctgtttactaaactccagcatctcacctacattatgtaactttttatcaaagttaagtgaaatg

SEQ ID NO: 121261 - DNA, 549 bp, Homo sapiens
  Payload ID: 3773
  Gene Symbol: CCDC91
  Gene Name: coiled-coil domain containing 91
  ENST ID: ENST00000536154
  CDS Start-End: 170-549
cttgcctgcagccatgtaagttgtgcctttgcttctccttcaccttccaccatgattgtgaggcctccccagccatgtggaattgcttctaaccctcctttatgtgactcagagaaaggagacctcattccaagttccaggattaattctgcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaaga

SEQ ID NO: 121262 - DNA, 1301 bp, Homo sapiens
  Payload ID: 3773
  Gene Symbol: CCDC91
  Gene Name: coiled-coil domain containing 91
  ENST ID: ENST00000536442
  CDS Start-End: 219-1301
aaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaa

SEQ ID NO: 121263 - DNA, 376 bp, Homo sapiens
  Payload ID: 3773
  Gene Symbol: CCDC91
  Gene Name: coiled-coil domain containing 91
  ENST ID: ENST00000535212
  CDS Start-End: 1-327
gcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggtaagtatctcctgaagagttttaatttgtgcttcaataaactgaatcagtgacttccatacaa

SEQ ID NO: 121264 - DNA, 575 bp, Homo sapiens
  Payload ID: 3773
  Gene Symbol: CCDC91
  Gene Name: coiled-coil domain containing 91
  ENST ID: ENST00000543534
  CDS Start-End: 301-575
actgcggaggaaagctttggacatgaaacctatttttggcttcactttaaggagtggaactctattaaaagctgcgctggtgtttttttgagacagaatcgcctaagctgaagtgtagtggcgccatcatagctcactgcagcctccagctccttggctcaagtgattctcctgcctgagcctccctagtagctaggactacaggtgctatacgtggatgacctgcttagttttaatttttggagaaatacattttataaaacattttcatcagattgctaaaattgtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagca

SEQ ID NO: 121265 - DNA, 166 bp, Homo sapiens
  Payload ID: 3773
  Gene Symbol: CCDC91
  Gene Name: coiled-coil domain containing 91
  ENST ID: ENST00000543019
  CDS Start-End: 1-83
tcgatcaagtcatccgccaaagaagcctgtccagtttggaactgttcctctcctgtgcacagaaacagagaagtctggcctaggaggtggaggatgcagcgcaccaagatcgcaccactgtactccaggatgggcaccagagtgagaccttgtctcaaaaaaaaaa

SEQ ID NO: 121266 - DNA, 305 bp, Homo sapiens
  Payload ID: 3773
  Gene Symbol: CCDC91
  Gene Name: coiled-coil domain containing 91
  ENST ID: ENST00000539270
  CDS Start-End: 1-93
ctcgatcaagtcatccgccaaagaagcctgtccagtttggaactgttcctctcctgtgcacagaaacaaccacggttgaccacaggtaactgaaaccacaggaatgagatgacagggatactgaggggctacttgtgagatggcaaaaaagagatatggcaaccagaatttccctcagtcgcccctgacaagttctcctacatcttcacacaaagagaagtctggcctaggaggtggaggatgcagcgcaccaagatcgcaccactgtactccaggatgggcaccagagtgagaccttgtctcaa

SEQ ID NO: 121267 - DNA, 2787 bp, Homo sapiens
  Payload ID: 3774
  Gene Symbol: CCDC92
  Gene Name: coiled-coil domain containing 92
  Uniprot ID: Q53HC0
  ENST ID: ENST00000238156
  CDS Start-End: 356-1351
ggcccgccgccgcgccggcgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgccttccttctgttttgtgtcttttattaaacaaacacctgaaggagggctaggagactgcaggagggagagcaatcacaggtcccagaagcgactccggcctcctcccggcccagagctagtccttagaatgtgctgcgctcctgagcttctgtgggaagctgcttttgcctctgatggcccctgcccactgtgctgcccgtgctagcccctctcctccctcatggagtgaagccacccctcacctccaggtggccagccagggctccaggccagcctcatggtgcacagagggaaggggtgcccagtgaccactggtcctggaggttctgtgtccttacctgaccccacacagacccaggcaggctgggggtagaagctcatgcaggaactaaacactaagctcaacaacttcacagtcgccgtagcaggtcagagccaaagaagctagggccagagagttctggaagggggagaagtggctccaggtgactggtcacttctgctctgtgcccgacatcatcagcccttcttgccaaaaaggagcatctgctgaaacagacctggatcatcgaaaacacacctttggaaattacattaggattctcacttgtgccaatgctatgtatgccaggcacttttgcctaatcaagtgttttctctgagaaggaaaagaaaactccacacatcttaaaatactctccaatatttactttttgattatataaattccttttaaaaagtagtattaaaaacaaaaccattcaggttaatttgtatggaaagaga

SEQ ID NO: 121268 - DNA, 555 bp, Homo sapiens
  Payload ID: 3774
  Gene Symbol: CCDC92
  Gene Name: coiled-coil domain containing 92
  ENST ID: ENST00000535556
  CDS Start-End: 267-555
atgggccacgggcccccaccgccgcccgccgggaggaccgagcctaagagggcagccgcctgaaggaacgcgacggcggcgcccgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacg

SEQ ID NO: 121269 - DNA, 751 bp, Homo sapiens
  Payload ID: 3774
  Gene Symbol: CCDC92
  Gene Name: coiled-coil domain containing 92
  ENST ID: ENST00000539761
  CDS Start-End: 386-751
caggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccccaacagaatcctggatttgagtctgtcctttgaaagcatctctgctagagttcccacttccaaacccctttcagctcttcgggattcagcctccaggttgccctcggagtggagtctgtggctttccaccggagcagcgcccaggaagtgttttcgtgtgatgaaagttatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacacc

SEQ ID NO: 121270 - DNA, 4883 bp, Homo sapiens
  Payload ID: 3774
  Gene Symbol: CCDC92
  Gene Name: coiled-coil domain containing 92
  Uniprot ID: Q53HC0
  ENST ID: ENST00000545135
  CDS Start-End: 3298-4242
gtcacttctcagaagcacctaaataggaagcccatggaaacaaaagcttttcaaccctgaagcccttacattcctctggcaccacagctgcactcaacagactggcaccaggcccattcgtgggcctccagggtgccaggcactgtgctagggcttagggtgcagcagtgaacaatctggagtctgtgcgaggaggcgggaaacagacccacacttacagaccctcacagagacacaaagactagaactggggacagggtggtaatgcacccgagtctgggggccagggcttccgggaggaagtaaacttgtactgagacctaaaggataagtagacagtggagacccaggagaggtgggtgggagagaggcctaagaagagtgttctgggcagaggaggagccatgagagggcaccagggtgggagaagcacagcccagcagggcacccggaggaaagctcgtgccacctggagccctgggggtaggagaagggccagcgagggtggcggggccagttgcagggccgggcagaccagtctgattctcagagcagtgggaaccattggaggtttttaagtagtctcaatttaaaaacaagatcactctgctgccacgtggagagcagaatggagcaggtaggagaggacagagggaggctttctggcagggatttgggtgagggtgaggacggcctcagcagcggagacggggagagttgaacggatctgagagctgctttcaaagcaggatgccagcaagatcatcatggactggaaatggatggcgggggatgccagcgtcaaggccacccccaggttgtgcagctggggacagtgcttgtgaggggtaggacactaggcctagggcagctctcctgtcatccaagacccactaaattctggatcacatttaaatggttctttctctttgacagcaagccactaacatatgggctctgcttcttccatcagccaacagaatcctggatttgagtctgtcctttgaaagcatctctgctagagttcccacttccaaacccctttcagctcttcgggattcagcctccaggtgaggtgctggaattgatgccagagtgaacgactccggattgctgagtggaaggaaaacgtaggcaccgctactgacagctctcaggcgctcctgggattttccttcctttgacgctgaggctgttccgctttcaagcgttctgctttgtgagggaagggcaaggtcagaaggtgctcaccctttccacagcaagcacgcggcacacgtgtgccacacgctgaacctgccttggttgtagctggctcctttgttaaggtcagcgccccccaagaccacgtgctgtgcagacagtgttgggatctcgggaactgtggggttccacttagaaactagtgtctggcccagcagcctacacaggagagtttgcggttacagcacagagacggtttcggggacagaaacatcctttctcactcctgccggaatgctgctcacggctccactgaggaaagccctgcttgatggaaactcaactctgccatcatctgcagcccagtgcgacggcagtcaaaggccagggagagctatgctttgttttatagaaacatgcctagaaatggtcgccttaagttatttaacccactccctattgtcgggttttgagtttgtttctagtcttttccaactgcaaactgcactgtagtgaccattctcacagctacctcttttcacacaaaagtaataatttccctttggtagatttctaaaaataaattgctagttcagagagatgaccaattccaaggcttctgatcagctctgcccaatcactgcccgtggtgaggtgccccccgagactgtacttgccgtgtcctggggccactgccctctcctgccagtttttgtccccaactgaaagggcctcttgtttctctttttcttggtcctttttaggatgtatcattgttcattccccttcgtgagctccgtcgtgttttatttccttctctgcgttctcaggttgccctcggagtggagtctgtggctttccaccggagcagcgcccaggaagtgttttcgtgtgatgaaagtgtatgtctgaagttcgttatgaactcgtcctagctccagagctagtgtgcatgcatgtcactggtcgtacagataattgatgagcaattggtgtcgtctgaagcagtgacagcctgggtgtgtcagtgtctccaaaacggttccactgtggcatcctacaaatgggctgcgtcctgggagccattgagaagttgtacctcctttacggagggttctctggaatagcaaattagggaaaatgcattctgaggttctgtatttacaataataatttataagcaaataactcacatttcatcctcagtatttttcagtgctgtacaagcgtcttgaattactctggtagcttttccagaaagacccatgacttcaccacatttctcgagttacgatgaaggtagagtctggggccctgagtgagcatcagatgctggaagctggggctgggaggggccaagcattggggacagactccagacacctgcaccaccccctggccccatgagatacgttctcagaccttcccaagaaggatctgtggctcctctcagtgctgtgaagtgcagggggcttccctctggaattcagcccatctctccctcctactttggctggctccagatgccatttagaggaaatgtttggcccatttcccaggtgccagcttttcccatgaggaagctgtcagtgcttcctggtcagggaaatcttttgggcgtgatttggtcagtcacagtctgttggggtgaggtggtgcgtggagaggacaggatttggaaccaagggtccctggattagaatccctgctccatacctcactggctgtgtgaccccaggctcgcgaatctgcctctcttgatctgtttcctcatgagtaaagggaaatgactttgtactctggagtgggcctcactcattcatgtgccaggcatcgtgctaggtgctagggcacaccccaaggcgttcgggaagcagaggctgccgtccctggcctggggcctccctgcagtgatgggaatgtagccctggtgcccccacaccctgcccttcaggagccgtggtttccttctgctctctcctgggaggcgcacacccctctgcacccagagccaaggagggcaggcagccctgggaccctcttcaggcaccgcagccagggtctgtgttacccacaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttct

SEQ ID NO: 121271 - DNA, 1790 bp, Homo sapiens
  Payload ID: 3774
  Gene Symbol: CCDC92
  Gene Name: coiled-coil domain containing 92
  Uniprot ID: Q53HC0
  ENST ID: ENST00000545891
  CDS Start-End: 224-1168
ctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatc

SEQ ID NO: 121272 - DNA, 559 bp, Homo sapiens
  Payload ID: 3774
  Gene Symbol: CCDC92
  Gene Name: coiled-coil domain containing 92
  ENST ID: ENST00000545037
  CDS Start-End: 524-559
agacacaggcccgccgccgcgccggcgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatgtatttttcagtgctgtacaagcgtcttgaattactctggtagcttttccagaaagacccatgacttcaccacatttctcgagttacgatgaaggt

SEQ ID NO: 121273 - DNA, 860 bp, Homo sapiens
  Payload ID: 3774
  Gene Symbol: CCDC92
  Gene Name: coiled-coil domain containing 92
  ENST ID: ENST00000539551
  CDS Start-End: 572-860
gtgggatcgcagggcgagggatccgcattgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccgtaagtacactaccttgccagccccttcctgaagctttgatgcggctttagtttactctgagtaacgatttgcctgtgattcgtgaaacggagcagaatgcacaaacgcagcagagctccaggcttggctactgggctgccgtctgctacggcgacacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatgtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaag

SEQ ID NO: 121274 - DNA, 1584 bp, Homo sapiens
  Payload ID: 3774
  Gene Symbol: CCDC92
  Gene Name: coiled-coil domain containing 92
  Uniprot ID: Q53HC0
  ENST ID: ENST00000614047
  CDS Start-End: 18-962
gtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatc

SEQ ID NO: 121275 - DNA, 348 bp, Homo sapiens
  Payload ID: 3774
  Gene Symbol: CCDC92
  Gene Name: coiled-coil domain containing 92
  ENST ID: ENST00000633868
  CDS Start-End: 60-348
tatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaag

SEQ ID NO: 121276 - DNA, 4064 bp, Homo sapiens
  Payload ID: 3774
  Gene Symbol: CCDC92
  Gene Name: coiled-coil domain containing 92
  Uniprot ID: Q53HC0
  ENST ID: ENST00000631749
  CDS Start-End: 2479-3423
tgtgcagctggggacagtgcttgtgaggggtaggacactaggcctagggcagctctcctgtcatccaagacccactaaattctggatcacatttaaatggttctttctctttgacagcaagccactaacatatgggctctgcttcttccatcagccaacagaatcctggatttgagtctgtcctttgaaagcatctctgctagagttcccacttccaaacccctttcagctcttcgggattcagcctccaggtgaggtgctggaattgatgccagagtgaacgactccggattgctgagtggaaggaaaacgtaggcaccgctactgacagctctcaggcgctcctgggattttccttcctttgacgctgaggctgttccgctttcaagcgttctgctttgtgagggaagggcaaggtcagaaggtgctcaccctttccacagcaagcacgcggcacacgtgtgccacacgctgaacctgccttggttgtagctggctcctttgttaaggtcagcgccccccaagaccacgtgctgtgcagacagtgttgggatctcgggaactgtggggttccacttagaaactagtgtctggcccagcagcctacacaggagagtttgcggttacagcacagagacggtttcggggacagaaacatcctttctcactcctgccggaatgctgctcacggctccactgaggaaagccctgcttgatggaaactcaactctgccatcatctgcagcccagtgcgacggcagtcaaaggccagggagagctatgctttgttttatagaaacatgcctagaaatggtcgccttaagttatttaacccactccctattgtcgggttttgagtttgtttctagtcttttccaactgcaaactgcactgtagtgaccattctcacagctacctcttttcacacaaaagtaataatttccctttggtagatttctaaaaataaattgctagttcagagagatgaccaattccaaggcttctgatcagctctgcccaatcactgcccgtggtgaggtgccccccgagactgtacttgccgtgtcctggggccactgccctctcctgccagtttttgtccccaactgaaagggcctcttgtttctctttttcttggtcctttttaggatgtatcattgttcattccccttcgtgagctccgtcgtgttttatttccttctctgcgttctcaggttgccctcggagtggagtctgtggctttccaccggagcagcgcccaggaagtgttttcgtgtgatgaaagtgtatgtctgaagttcgttatgaactcgtcctagctccagagctagtgtgcatgcatgtcactggtcgtacagataattgatgagcaattggtgtcgtctgaagcagtgacagcctgggtgtgtcagtgtctccaaaacggttccactgtggcatcctacaaatgggctgcgtcctgggagccattgagaagttgtacctcctttacggagggttctctggaatagcaaattagggaaaatgcattctgaggttctgtatttacaataataatttataagcaaataactcacatttcatcctcagtatttttcagtgctgtacaagcgtcttgaattactctggtagcttttccagaaagacccatgacttcaccacatttctcgagttacgatgaaggtagagtctggggccctgagtgagcatcagatgctggaagctggggctgggaggggccaagcattggggacagactccagacacctgcaccaccccctggccccatgagatacgttctcagaccttcccaagaaggatctgtggctcctctcagtgctgtgaagtgcagggggcttccctctggaattcagcccatctctccctcctactttggctggctccagatgccatttagaggaaatgtttggcccatttcccaggtgccagcttttcccatgaggaagctgtcagtgcttcctggtcagggaaatcttttgggcgtgatttggtcagtcacagtctgttggggtgaggtggtgcgtggagaggacaggatttggaaccaagggtccctggattagaatccctgctccatacctcactggctgtgtgaccccaggctcgcgaatctgcctctcttgatctgtttcctcatgagtaaagggaaatgactttgtactctggagtgggcctcactcattcatgtgccaggcatcgtgctaggtgctagggcacaccccaaggcgttcgggaagcagaggctgccgtccctggcctggggcctccctgcagtgatgggaatgtagccctggtgcccccacaccctgcccttcaggagccgtggtttccttctgctctctcctgggaggcgcacacccctctgcacccagagccaaggagggcaggcagccctgggaccctcttcaggcaccgcagccagggtctgtgttacccacaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttct

SEQ ID NO: 121277 - DNA, 111 bp, Homo sapiens
  Payload ID: 3774
  Gene Symbol: CCDC92
  Gene Name: coiled-coil domain containing 92
  ENST ID: ENST00000631954
  CDS Start-End: 60-111
tatttttcagtgctgtacaagcgtcttgaattactctggtagcttttccagaaagacccatgacttcaccacatttctcgagttacgatgaaggtcctctggatgtcagca

SEQ ID NO: 121278 - DNA, 594 bp, Homo sapiens
  Payload ID: 3774
  Gene Symbol: CCDC92
  Gene Name: coiled-coil domain containing 92
  ENST ID: ENST00000633908
  CDS Start-End: 229-594
ccaacagaatcctggatttgagtctgtcctttgaaagcatctctgctagagttcccacttccaaacccctttcagctcttcgggattcagcctccaggttgccctcggagtggagtctgtggctttccaccggagcagcgcccaggaagtgttttcgtgtgatgaaagttatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacacc

SEQ ID NO: 121279 - DNA, 306 bp, Homo sapiens
  Payload ID: 3774
  Gene Symbol: CCDC92
  Gene Name: coiled-coil domain containing 92
  ENST ID: ENST00000633097
  CDS Start-End: 18-306
gtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacg

SEQ ID NO: 121280 - DNA, 2491 bp, Homo sapiens
  Payload ID: 3774
  Gene Symbol: CCDC92
  Gene Name: coiled-coil domain containing 92
  Uniprot ID: Q53HC0
  ENST ID: ENST00000632401
  CDS Start-End: 60-1055
tatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgccttccttctgttttgtgtcttttattaaacaaacacctgaaggagggctaggagactgcaggagggagagcaatcacaggtcccagaagcgactccggcctcctcccggcccagagctagtccttagaatgtgctgcgctcctgagcttctgtgggaagctgcttttgcctctgatggcccctgcccactgtgctgcccgtgctagcccctctcctccctcatggagtgaagccacccctcacctccaggtggccagccagggctccaggccagcctcatggtgcacagagggaaggggtgcccagtgaccactggtcctggaggttctgtgtccttacctgaccccacacagacccaggcaggctgggggtagaagctcatgcaggaactaaacactaagctcaacaacttcacagtcgccgtagcaggtcagagccaaagaagctagggccagagagttctggaagggggagaagtggctccaggtgactggtcacttctgctctgtgcccgacatcatcagcccttcttgccaaaaaggagcatctgctgaaacagacctggatcatcgaaaacacacctttggaaattacattaggattctcacttgtgccaatgctatgtatgccaggcacttttgcctaatcaagtgttttctctgagaaggaaaagaaaactccacacatcttaaaatactctccaatatttactttttgattatataaattccttttaaaaagtagtattaaaaacaaaaccattcaggttaatttgtatggaaagaga

SEQ ID NO: 121281 - DNA, 6896 bp, Homo sapiens
  Payload ID: 3775
  Gene Symbol: CCDC93
  Gene Name: coiled-coil domain containing 93
  ENST ID: ENST00000319432
  CDS Start-End: 139-2031
ggcggcggcggcggcggcggcggcggcagagggagtttccgctttgtactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgggtcatggtctgagccaggagagagatagacactgttccctgcactcaaggcaagtagggtgtcaggaggaagagcagtagggtttgcagagatccagggaaacttcctggaggaggcagcatttgagccctatctaaagggagaatcggatgttgataggaagactgttttaaatgaaaatacactatgattaaaaacccaagagagtgcagaggagtacaaggcatgcatgttgggaaaggagggaataagctagtctctgcaggaggcttcagagacccgtctgggaagtagggctgagactaggctttggagggccttgaagggcagctgagggttgattttaatccttggaaatgaccagtgcagatcaaacatggagctcctgctgccctggtcctcaggagtctggtaactcagtcatgttctgtaggtttgtgctccattttgcataaatcttgcaaacataccaggtggcaggtttgcacagtaacacaaaagcttaaacatgtcaagcaagtggggcattcagcagccacagaaatgtgttcatttttagtccctaatggatgtgattaagcagggctgatgtgtacagatttaaaaacacacacacgtgctggattaaaaacagccactggtttcagtgccagggccagcaaggcctacctgagccaggcggaagcagcagcttgcaaatagaaactgccacctgcgagcgcttcttgggtcatgtgcagctccacctcagctggtccctgagccgtggtcatgtgggggttttgaagggctaagttgaagcaagtaattgcaaaagaacaggtggcactctgagggcaggggaaggagacagaagtttgactgcgtttgaaattatttcagtcagggaaacatctgcgttgtcttgttaagcagcttgtaggcccacccctggctaactgaactttgtgagcagttggggcagttatttgaatatttgtccaaaggtggtagggaggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttacatgactttttggtgaagccgtatagggtaaggagatgccccaaggcccctgatcatttcagaagccacctggagcaccagaaggggtcatcttcccagggctatggctctgtgtgcttagacagacatagtatggaattgtgctctaagcccacaggcttctccggagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccagggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagatttttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaatttttaatttggtatacttttcttaatagaaccaaaatggaagaaaattctgattctctaaatctgctttcttaaagataaagcctttgattcaaaagta

SEQ ID NO: 121282 - DNA, 6899 bp, Homo sapiens
  Payload ID: 3775
  Gene Symbol: CCDC93
  Gene Name: coiled-coil domain containing 93
  Uniprot ID: Q567U6
  ENST ID: ENST00000376300
  CDS Start-End: 139-2034
ggcggcggcggcggcggcggcggcggcagagggagtttccgctttgtactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaaattctggagctcttggttgcagctgggtatttcagggcaagaattaaaggcttatcaccctttgacaaggtagtaggaggaatgacttggtgtatcaccacttgcaactttgatgtagatgttgatttgctctttcaagaaaactctacgataggtcaaaaaatagctctgtcagaaaaaattgtctcggtcctgccaaggatgaaatgcccacaccagctggagccccaccagatccaggggatggattttattcacatatttcctgttgttcagtggctggtgaaacgagctatagaaacaaaagaagagatgggtgactatatccgctcctactctgtatcccagttccagaagacttacagtctccctgaggatgatgacttcataaagagaaaagaaaaggccatcaagacagttgtggacctctcagaagtgtacaagccccgtcggaaatacaaacgccaccagggagcagaggagctacttgatgaagaatctcgaatccatgctacacttttggaatatggcaggagatatggatttagccgccagagcaaaatggagaaggctgaggacaagaaaacggcacttccagcagggctgtcagctacagaaaaagctgatgcccacgaggaagatgagcttcgagcagctgaagagcagcgtattcagtcgctgatgaccaagatgaccgctatggcaaatgaggagagccgtctcaccgcaagctccgtgggccagattgtgggactctgctctgctgagatcaagcagattgtgtccgagtatgcagagaagcagtctgagctatcagctgaagaaagtccagaaaaattaggaacctcccagctacatcgccggaaagtcatttccttgaacaaacagattgcgcaaaagaccaaacatcttgaagagctgcgagcaagtcacaccagcctacaagccagatataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgggtcatggtctgagccaggagagagatagacactgttccctgcactcaaggcaagtagggtgtcaggaggaagagcagtagggtttgcagagatccagggaaacttcctggaggaggcagcatttgagccctatctaaagggagaatcggatgttgataggaagactgttttaaatgaaaatacactatgattaaaaacccaagagagtgcagaggagtacaaggcatgcatgttgggaaaggagggaataagctagtctctgcaggaggcttcagagacccgtctgggaagtagggctgagactaggctttggagggccttgaagggcagctgagggttgattttaatccttggaaatgaccagtgcagatcaaacatggagctcctgctgccctggtcctcaggagtctggtaactcagtcatgttctgtaggtttgtgctccattttgcataaatcttgcaaacataccaggtggcaggtttgcacagtaacacaaaagcttaaacatgtcaagcaagtggggcattcagcagccacagaaatgtgttcatttttagtccctaatggatgtgattaagcagggctgatgtgtacagatttaaaaacacacacacgtgctggattaaaaacagccactggtttcagtgccagggccagcaaggcctacctgagccaggcggaagcagcagcttgcaaatagaaactgccacctgcgagcgcttcttgggtcatgtgcagctccacctcagctggtccctgagccgtggtcatgtgggggttttgaagggctaagttgaagcaagtaattgcaaaagaacaggtggcactctgagggcaggggaaggagacagaagtttgactgcgtttgaaattatttcagtcagggaaacatctgcgttgtcttgttaagcagcttgtaggcccacccctggctaactgaactttgtgagcagttggggcagttatttgaatatttgtccaaaggtggtagggaggcagatgacattctggggttactggagtccacctctgtgctgatggggaaagtatggcatgatgaatccaaagcaaccagtaattctttttgaaagtgcaggcatttattttgagctgtatttcataggagtttcatttggtttggttttggtatagagaggtgtccatagatctctattccctttttttttttatcgacaaggcctactacggataaatcagtttttgttgcctgaatacactttgaattagactacagaagccagtttgagctcaaatttcacacttgctgcagacaactctcagtgtggacagtgcctttctgagtaattaggatgttacatgactttttggtgaagccgtatagggtaaggagatgccccaaggcccctgatcatttcagaagccacctggagcaccagaaggggtcatcttcccagggctatggctctgtgtgcttagacagacatagtatggaattgtgctctaagcccacaggcttctccggagttaaaaggaagcaagaacatccttaagttactttttcaaaatatgcgcttcaggaggaaccaggtttccccaggagagagaggctccctgctcaatcagcacagggagttgctagcgggcaggctgcccagtgctgtggaatctccgccagcctctgggttgggggctccctcccacttcttgcttcttatggagtacatgggactgctctgctttaagccgcgatcagagctgttgtgagcaggacaagattgcgtgatcacgaggtgcgtggggagatgctaggacatttgttgatgtctttgacctgtgctccgtctctgttggatgactgggttagctaacaccactagagggaggtacagaatgttaaacagtcgtcagagtcacactgagggttgttttaacagagggcaaattcccagtttgtcaagcatatctctgttagagtccgaagttcatggttttaatggttctagctcgtagcccttaatattttcaggatagctgggtcctgccagtgtccgctgagtccatcagcacaaccagaaggtccagggtccaggcatgggaagcattctctgacaataccgagccctcgggacctcctgaaaccttgagcagaggctggagaagaccttcagacagtccttttactacctcacaaagtgccatgcccgggacctcagacctcagggttgtgacgttgttgatgttgtcaggccccagtacgtctctagtgaccgaagcagacctgcctgaaagggcactccggacagtgagccctggctctaacctgtgccctcatatttctgctgcctcatatggtcttgtttgcccactctgtaggtgactgatcaccctaaaagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagatttttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaagaggggtgggaatgacttttcaatgtacaccttttgtaccttttgaattttgtaccatgtacatgtattatctattaaaaaatagttcttaatttttaatttggtatacttttcttaatagaaccaaaatggaagaaaattctgattctctaaatctgctttcttaaagataaagcctttgattcaaaagta

SEQ ID NO: 121283 - DNA, 850 bp, Homo sapiens
  Payload ID: 3775
  Gene Symbol: CCDC93
  Gene Name: coiled-coil domain containing 93
  ENST ID: ENST00000437999
  CDS Start-End: 1-276
cagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgagaatgagcttcagcactcttccagtgaagtctgttggattttgcctgcagctgagccccttgggaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaactctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttactt

SEQ ID NO: 121284 - DNA, 1434 bp, Homo sapiens
  Payload ID: 3776
  Gene Symbol: CCDC94
  Gene Name: coiled-coil domain containing 94
  Uniprot ID: Q9BW85
  ENST ID: ENST00000262962
  CDS Start-End: 69-1040
cggaaaagctcgataattacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgcggccctgttggaggaagccagaaagcgaagactgctggaggactccgactcagaggatgaggctgctccctcgcccctgcagccagcccttcggcccaaccccaccgccatcctggatgaggccccaaagcccaagaggaaggtggaggtctgggagcagagcgttggcagcctgggcagccggcccccgctgtcgaggctggtcgtggtgaagaaggcaaaggccgacccggactgcagcaacgggcagcctcaggcggcccccaccccaggagccccgcagaacaggaaggaggccaaccctacacccctgacgcctggcgcgtcctccctgagccaactgggtgcatacctggacagtgacgacagcaacggcagcaactgagccctcccaggaccccctcacggggtcaaagtcacacgtccagcttcagccacattgaggccagcattgctggtggtcagggcaggaggccttggcgtgactggaggccggacagacaagcgccagcgtgctccaacacatagggccaccaggggcctcagccccaggaggtcccttctctgtgccctcaccagcctctcaacacctcggggacccctgctgctcctgcccccacctgtcactgtgcttagggctgcaacatccctggagcagcttccaacactacttcagggtggcagtgtttggggcactgggcgagcctgccggcctctagatggcctcatctcttccttccacaaactgtctagaaccaataaaaggaaacctgccaacc

SEQ ID NO: 121285 - DNA, 800 bp, Homo sapiens
  Payload ID: 3776
  Gene Symbol: CCDC94
  Gene Name: coiled-coil domain containing 94
  ENST ID: ENST00000596496
  CDS Start-End: 319-800
cgccaccatgcctggttaattttttttgtattttagtagagatgagatttcaccatgttgcccagggtggttttgaactcttgatctcaggcattccacccacctcatactcccaaagtgctggaattacaggcgtgagccaccgcgcccggccccacgcaggtctttctaggagagcagtctcaggcttgctgtaggaactcctgggaaacaggagccctgggatacaaagggagtaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaatgctcggaaggagacggtgcagaacgaggtctacctgggcctgcccatcttccgcttttacatcaagtgcacgcgctgcctggcagagatcaccttcaagacagaccctgaaaacacagactacaccatggagcatggagccacgcggaatttccaggctgagaagctcctggaggaggaggagaagagggtgcagaaggagcgggaggacgaggagctgaacaaccccatgaaggtgctggagaaccggaccaaggactccaagctggagatggaggtgctggagaacctccaggagctgaaagacctgaaccagcggcaggcgcacgtggacttcgaggctatgctgaggcagcaccgcctgtcggaggaggagcggcggaggcagcagcaggaggaggacgagcaggagaccgc

SEQ ID NO: 121286 - DNA, 2091 bp, Homo sapiens
  Payload ID: 3777
  Gene Symbol: CCDC96
  Gene Name: coiled-coil domain containing 96
  Uniprot ID: Q2M329
  ENST ID: ENST00000310085
  CDS Start-End: 2-1669
gatggacgtcagctctgagcacactaaggaccccggcggggaaggcggagacggggaaagcctggccgcgcggccgtccaagatcaaggccagctctggccctccgacctctcccgaacccggggagctggagtcggagccggaggaggaggaggaggagcaagcggcttcgcagggaggcaccgccgcggacgagcaggccgaggccccgaaagggctaacggcagccgaggctgcgggcgaggaggggcctggagagccggggaggccggccgagccccagcccgagcccgaagagccggccgaggttggggctgaggagcccgcccagccggagcccggagccgggcccgaggaactagaggcggaggcgggggcggaggaactggagcaggcggcagaggggaaggaagtcaggttccaggcctctctgccgctgaccaggatcgatgaggaagaggctgctgcagccccggaggccgagacagagcgggtggagggggaggaagaggacaaggaggagacgcagagagacggcgcggagagcaaggagagggatggggaaggacgcccggccaaaagccaggaagaggggaagcgcctctatggaagggacgagtttgaggacctcgagtggtccgaggaggtccagaagctgcaggagcagcagctgcgcagcgacctcctggaccagtaccgttccctgctggtggagcggaaccgctcccagcgctacaacctatacctgcagcacaagatcttcgaggcgctgcgcagaaagaagggcctggaggccgctgaggtggctgaccggggcgcagaggccgaggcccccgagaaagagcaagcgtacctgcgccatctgggcatgctggaggagctgaagaagcagcaggcagacgacctgcagtggtaccaccaggagctgggccagttgaagcggcagtgccaggagaagctcaccagggtggagaaggagtggcgacgcttccaggcactcaagaagcaggtggtgatgcaggccatgggcagctgtcggatgaggggcgggcgccaggctgctctgcgagaggtggagcagatccaggcgttggaggataaaaaggagaaggagatgagcgccgtgcggctggagaacattcagctgaagcagagcctggtgcattttgaaaccaggatgaggacccaggaggacctgacccagggtctgcttcttattgactttgaacagctgaagattgagaaccaaaccttcaatgagaaaattgaggaacgaaatgaggaacttttaaaacttcgcagcaaggtgaccaacagtgtgcaagtaataacccacgtgaaggaaaagctgcacttcatggacatggagaacgcgtgcaaaaagacacagctggcagaaatcgaggcccaggccgccctaggaagagacatcctgaccaagacgaagcaagcccgagaggggctgcggacggacaacatcagactgaatcagaagtgcggccttctaggcaaggactcacttcttcgggacttggaagaaaaggtggacaagaccgaactgcttcaccggcgcctggaatccctgaagcgccaccacgctagcctcactttgtcctgcagaggcgtgaggcagaagatcagggaggccaaagcctttctcccttcttgaccagatcgatgagaagagtctgcaaaacacttcatcctcaggacgtgctgtcctgctttattttaccttcgttgctattaaaaaggcctgtgtcatttgggacgggactctattttgtatttatctcaaaacgttttagcttccaaatcagtgctgagcccaaacctgggttaggagttttatctgggattgagcaaaaataggtccagaaaagcaaacaaagggtgatttaatgtaactgacttctcatgaaaaactgtcaaaagtctcaagtctgagcaattctataatttcagtgatgtaatactaaagagtactgttcctctttcatatgtaggagggtttaaaagttcagcgaatgggcaaggtacaaaaaaaccctgtgcattaagctaattattaaattctttggatttattaaa

SEQ ID NO: 121287 - DNA, 3322 bp, Homo sapiens
  Payload ID: 3778
  Gene Symbol: CCDC97
  Gene Name: coiled-coil domain containing 97
  Uniprot ID: Q96F63
  ENST ID: ENST00000269967
  CDS Start-End: 123-1154
gcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaagggggcgagtacttcagtgatgagcagatgcggttccgggcccccctgctatatgagcagtacatcgggcagtatctcacccaggaggagctcagtgcccgcaccccaacccaccagccccccaagcccgggtcccccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacagcacagtagacgacaaccccgacttcgacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatcccccactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccgtgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatatctctcagaaagccaagagtgcaggatgagagctgtctgtctcttacctgcctgtatttgtgccccatttttaaagagcagagggcctgggccacaggaaaggtatcagcccttggtgataggcacattttttaccagtctatcatttggtcattaaatttgtttacaatatactttgctata

SEQ ID NO: 121288 - DNA, 534 bp, Homo sapiens
  Payload ID: 3778
  Gene Symbol: CCDC97
  Gene Name: coiled-coil domain containing 97
  ENST ID: ENST00000600918
  CDS Start-End: 1-464
ccaacttgctgctccagtcctacgaggagcgggagctacagcagcgtctgctccaacagcaggaggaggaggaggcctgcttggaggaagaggaagaggaggaggacagtgacgaggaagaccagaggtcaggcaaggactcggaggcctgggttcccgactcggaggagaggctgatcctgcgagaggagttcaccagccgcatgcaccagcgcttcctagatggcaaggacggggactttgactacaggtgctcctgtgcctccacctccccatcccccagcccagcatcccacggcctttggtcacatgcagagcccttaacaagctgtgggggtctccctttgtggagctacaaggccccaaaacagttccaggatgtggggttgaacagccaaaggaagaggctgggtgacctcggactagccttgtccatctcagaccctcagtctcctcacctctaaggcaggggatggacagggatgacatatagctcagtatcaatgaaaccctgaaacacttccctcctggcaa

SEQ ID NO: 121289 - DNA, 413 bp, Homo sapiens
  Payload ID: 3778
  Gene Symbol: CCDC97
  Gene Name: coiled-coil domain containing 97
  ENST ID: ENST00000596882
  CDS Start-End: 365-413
tctaacgattccttcatttcattgtaactcccgtttcccccaaagtccgaaatccagccaggctcctttcaaagtccttactcaatttctgtgctttcccacaaccttcaaagtaatccgacgtcgggtgaggtgtgattggaagcgtggctccaacaccactggccaagaattggtaattgtggaagccagatggagatgattggtatatggaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagc

SEQ ID NO: 121290 - DNA, 1057 bp, Homo sapiens
  Payload ID: 3779
  Gene Symbol: CCER2
  Gene Name: Coiled-coil glutamate rich protein 2
  ENST ID: ENST00000635114
  CDS Start-End: 1-801
atgccgccccgagggccagcctctgagctgctgctgctgcggctgctcctgctgggggcggccaccgctgctcccttggcaccgagaccctccaaggaggagctgacccgctgtctggcagaggtggtcacagaggtgctgaccgtgggccaggtccagagaggaccctgcactgctcttctccacaaggagttgtgcgggacagagccccacggctgtgcgtccaccgaggagaaaggcctgctgcttggggatttcaagaagcaggaggctgggaagatgaggtccagccaggaggtgagggatgaggaagaggaggaggtagcagagaggacccacaagtctgaggtccaggaacaagccatccgcatgcaagggcatcgccagctccaccaggaggaggacgaggaggaggagaaggaggagaggaagagggggcccatggagacctttgaggacctgtggcagcggcatctagagaatggaggggacctccagaagcgggtggcagagaaggccagtgacaaagagacggcccagttccaggcagaggagaagggggtgcgggtgctgggcggggaccgcagcctgtggcagggggccgagagaggcggaggagagaggcgcgaggacttgccccaccaccaccaccaccaccaccagccagaggctgagcccaggcaggagaaggaggaggcttcggagagggaggaaaaggaggtggagcagctggagcacttgagagacgaactgaagaaggtgacagagacgctgggggagcagctcaggagggagggctgacccctacctcagtccctccttcctcctgacacaccctgtggcttaggactgttgaccccgaagcctccacctcacctagcaccccacgccacccctacccaaacaggggaggaggcggacgtgccttggaaccacacccaaggaggtgagtctgagctgggccgggggctgggctcagccctgacacaggaagcacccccacacctatgcactcccactccaacccttctgagtgaataaagcacaaagaaacgca

SEQ ID NO: 121291 - DNA, 570 bp, Homo sapiens
  Payload ID: 3779
  Gene Symbol: CCER2
  Gene Name: Coiled-coil glutamate rich protein 2
  ENST ID: ENST00000635007
  CDS Start-End: 1-369
gaggacgaggaggaggagaaggaggagaggaagagggggcccatggagacctttgaggacctgtggcagcggcatctagagaatggaggggacctccagaagcgggtggcagagaaggccagtgacaaagagacggcccagttccaggcagaggagaagggggtgcgggtgctgggcggggaccgcagcctgtggcagggggccgagagaggcggaggagagaggcgcgaggacttgccccaccaccaccaccaccaccaccagccagaggctgagcccaggcaggagaaggaggaggcttcggagagggaggaaaaggaggtggagcagctggagcacttgagagacgaactgaagaaggactgttgaccccgaagcctccacctcacctagcaccccacgccacccctacccaaacaggggaggaggcggacgtgccttggaaccacacccaaggaggtgagtctgagctgggccgggggctgggctcagccctgacacaggaagcacccccacacctatgcactcccactccaacccttctgagtgaataaagcacaaagaaacgca

SEQ ID NO: 121292 - DNA, 2962 bp, Homo sapiens
  Payload ID: 3780
  Gene Symbol: CCER1
  Gene Name: coiled-coil glutamate-rich protein 1
  Uniprot ID: Q8TC90
  ENST ID: ENST00000358859
  CDS Start-End: 435-1655
acagtcctgccaggacggcgacagtgaagcacctgggttgagagggagcagcaggtaactgcgcaacccctgcctcccccggccccagcccgtgcctcagcagagccgggtgtggtggggacccgggagtgggtctcactgcgtgtcgcctgccaacaccttcctcccccaccatccttacccagccccagtcccacccagcacacctgggcgagacaacccaggtgcgaaggacaagcgattactaccgaagagcgtgcaaaccaggaagagagcagcctcctggagaggaaaacgtgatcccaggggtagacacgtggcgctgcgtggagagacaggttgacgagacgaggctcttctgaccgtcctacctggcaaaacttgacgacagcttcaggtcgctaccatctggacctctcggagctccctgaaccatgactcagaccctcgacacaagggaagaccctctgaacctgggcggcggtggcggcggcggctgtggctgtggctgggcacactcggcctccttgagctcctggtcgtcctgccatcgaaggcgcccgggtgctccagcgtacaatagaccgcaccgatatagccccaagaccgagtatgggcccccaaggaagcagccgaagcaacagcacggcccgggcttttggttccaaccacccgtgtgctctaactgggggtgctggggagggccctggcgcccaccccctccaggattctggaaattcccctgcccggtgcaagtgtttcgggtgtatggcctgcaccctctctgcttttgctgctgctcctgctggagcgggtcctggaaccctggctgggtgaagcccccaggcaggaagaagcgctggggccgcagaggccgcggcctgcgccaccaccctcgccactcctacccgcggagcccgccagcggatgtgagcacgctgccgcggccggtcaagctgtatgagtggagagagcctggcatgcgagcgccgcccaacaccacccaattcatcatgaaccagatctacgaggacatgaggcagcaggagaaggtggagcgtcagcaggaggcgctgcgggcgcagaaggccacggtgagcggcgaggcctccccagccagatcctccggaaacgacgcgccccctggcggcagcaaggaaacctggggactgcaggaaactctgtatggctttgtgcagaatccctctctagcattcagtcccaacccagaggaaaaccagtctcttgccccgctgctggtggaagaagaggaggagaagaaaaatgatgatgaggaggagtatgaccaggaggtgtgtgatgcaaaggaggcgagcgaggaggaagaagaggtcgaagatgaggaggaagaggtcgaagatgaggaggaagaagaggtcgaagaggctgaatatgtggaggagggagaggaggagctggaagaggaggagctggaagaggaagaggaggtcctggaggagaacgagcagagaggggaagaatttcacttgcctctggaaatgcctttatcaatcttcgtagaggctgaagaaaagagagagaactttataagctgcacttttttaaacccagagcagataattcccaaagtgccacaggaatccctgttcatggcacaggactttaactgttagacatcagaaaagggattgagaaaagggatggaactgatttgaggctaaactggattagcaatttattaaaaactgattaaaaagtgagttccattaataaacagatctatgtaaacaccttctttggccattataaaatgtttaaaatttgatgcgtatgtgtatgactatgggtgggtggtggggaagctttcaaatataattttactggaactgattaaaggccaagtattttattactaccatttgaatattttcatttggtgttttcccctctagaaaacagagttgctgttgtttttttaaatctggcaatgctgaaaaagcgtttgtttttgaaacaaatttatacaacttggccacttaatgagcttggaatcaagagatagtttattacatgcgtaagaagcacattctaacgctactaaatgttcaccagtgctcttaacataactgaagccattttcaatccctgtattttttcaacaatatttttcctcatagatttttccaccatcagagttcatttttgagggttatattttgttaacctcatttgcaggctcttgtgtcatcgcttattgatattccttgttccacagtgctatggatcttcctcagaagaacatgaagttgcttctgtggaactggttatctgccatggcctcaacaatccataatccagtcatggagaggattccccatggtcagaagtcaacttgcacatctagttaaagtccaaggtaactgcaaacagtggaacatggcttaggttttgaagcctcgttattggatatagtctttatcctaagttctgaggagccataaaaatagttttccagaatggatttttttttttagataaaaagattatctaccttttgggggtggaatatcttattttgtttttgaatttgtctttgttataaagaagagtaaaacaaagatgtgtaagtgtgagtctgtgtgagctagtttctgatgtctaaacagcaattacctatggagaatacatcattcaaagtaatagcttttgttcaaacatttttaggaagtaataatacatttcttcctggacagttgataaaagttccatccatagcatatttccagaatatccctagatgatgaatttaaacatgccttctcagaaattaaatcttttgactttgaaccacaagttagcatttatttgttgaagagaagaatgtgtggtgatgtcttacctgaatgttggttgttactgatatattacaattttcaaggtgataagcttgagctattaaataataaaaagtattaaagta

SEQ ID NO: 121293 - DNA, 683 bp, Homo sapiens
  Payload ID: 3780
  Gene Symbol: CCER1
  Gene Name: coiled-coil glutamate-rich protein 1
  ENST ID: ENST00000549707
  CDS Start-End: 1-175
gaacgagcagagaggggaagaatttcacttgcctctggaaatgcctttatcaatcttcgtagaggctgaagaaaagagagagaactttataagctgcacttttttaaacccagagcagataattcccaaagtgccacaggaatccctgttcatggcacaggactttaactgttagacatcagaaaagggattgagaaaagggatggaactgatttgaggctaaactggattagcaatttattaaaaactgattaaaaatgctatggatcttcctcagaagaacatgaagttgcttctgtggaactggttatctgccatggcctcaacaatccataatccagtcatggagaggattccccatggtcagaagtcaacttgcacatctagttaaagtccaaggtaactgcaaacagtggaacatggcttaggttttgaagcctcgttattggatatagtctttatcctaagttctgaggagccataaaaatagttttccagaatggatttttttttttagataaaaagattatctaccttttgggggtggaatatcttattttgtttttgaatttgtctttgttataaagaagagtaaaacaaagatgtgtaagtgtgagtctgtgtgagctagtttctgatgtctaaacagcaattacctatggagaatacatcattcaaagtaa

SEQ ID NO: 121294 - DNA, 1057 bp, Homo sapiens; identical to SEQ ID NO: 121290
  Payload ID: 3781
  Gene Symbol: CCER2
  Gene Name: coiled-coil glutamate-rich protein 2
  Uniprot ID: I3L3R5
  ENST ID: ENST00000571838
  CDS Start-End: 1-801

SEQ ID NO: 121295 - DNA, 570 bp, Homo sapiens; identical to SEQ ID NO: 121291
  Payload ID: 3781
  Gene Symbol: CCER2
  Gene Name: coiled-coil glutamate-rich protein 2
  ENST ID: ENST00000571845
  CDS Start-End: 1-369

SEQ ID NO: 121296 - DNA, 3927 bp, Homo sapiens
  Payload ID: 3782
  Gene Symbol: CCSER1
  Gene Name: coiled-coil serine-rich protein 1
  Uniprot ID: Q9C0I3
  ENST ID: ENST00000432775
  CDS Start-End: 355-2388
gttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaagaccacataccctagggaattctgaaaacctgactaacatcaattgaagattggggttcaggaggcctagatgatccaccatgacttattcaaaagttgaagatgaaaggaaagaataaagactctttccatccagttctctagtctgaaaggaaaagaaataggcaaaggacagtaggcttttctatatcattatattcattcaaatgattctcttaaaataataatgaactaaggaggctctgtaagcaagacaaacggtcaggaggcctccttgctccaagaatactccctttttactttattaaaatggtttgtaaaggtaaactaaattgactaaagtatcaatatttccatatatgcgtgatcttttagagaccataaactgtcagtgtattaggctgttcttgcatggctataaagaaatacctgagactaggtgatttataagaaaaggggtataattggcccacagttctgcagactgtacaggaagcatagtagcatgtgcttctggggaggcctcaggaagcttccaatcgtggcggaaggcaaagggaagcaggcacattgcatggtgagaacagaaacaagaacaaggaagggtggctgggaggcgccacataattttaaattaccagatctcacaagaactcactatccggaagacagcacccagccatgagggatccaccctcatgattcaaacacctcccaccaagccccacctccagcactggggatcacaactcgacatgagatttgagcagagacaaatttccaaactatatcactcagaatctggaatagaaagagtatgcaccataacacttttattctctacagaaacagacactgtgctgagctcaaaaaatagtgattcatcaaatatgaatgtgcaaacctcttttgtactgtatctgtggaatcctggttactggggctttgagcccctgtcccataaaatctctgtaatactaacctaactcatggcatttctttaaaatcaaatttaatgaaatgatggacataaagcccatggaactgagtgtgtaatcttctcttatttgattagatgttaaacttgaaacacttttttttgataaaatatgaaatacataaatgagttaaattgttgtgactttccttataagattgaaaacaataaggtgtttttaatactttttttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttacaaaaaaagataaaatcgtattgaagagactgttgaatatgaacgcagtgtattaaatgcccgatataggaacaaaaataaaatgaagaacatttctattataaa

SEQ ID NO: 121297 - DNA, 2684 bp, Homo sapiens
  Payload ID: 3782
  Gene Symbol: CCSER1
  Gene Name: coiled-coil serine-rich protein 1
  ENST ID: ENST00000505073
  CDS Start-End: 339-2330
aaatagtcgccgacctactgccaatccgcctctcctctctctctctctctgtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggttcacttgtcaaggatgagtgtttccaattctacaaataaaaattgtattattttctagttgtatgaaagtgaagctaatgcttaagaatagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatgtaagtagctctgtaaaaccatttttaacttcattattggcattcagacctccacagcttattgacctctgcggctgctgtgt

SEQ ID NO: 121298 - DNA, 445 bp, Homo sapiens
  Payload ID: 3782
  Gene Symbol: CCSER1
  Gene Name: coiled-coil serine-rich protein 1
  ENST ID: ENST00000503421
  CDS Start-End: 234-445
tctaccatgtgaggacacagtgagaaggcagctatttgcaagccaggaagagagccatcaccaagaactgaatctgccagccccttcatcttggatttcccagcctccaaaactctacaagttagagttggattatctacattacgaagagaggaaagtgattgtaaaactagactttatttcattcagcaaaggaaattcattggcagggtgagactagtcgaagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgctcccgaaaattttgtgttccatgagaggaggttttatttgcttggctgtgtttcttga

SEQ ID NO: 121299 - DNA, 1070 bp, Homo sapiens
  Payload ID: 3782
  Gene Symbol: CCSER1
  Gene Name: coiled-coil serine-rich protein 1
  ENST ID: ENST00000509109
  CDS Start-End: 115-396
tgaggacacagtgagaaggcagctatttgcaagccaggaagagagccatcaccaagaactgaatctgccagccccttcatcttggatttcccagcctccaaaactagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgctcccgaaaattttgtgttccatgagaggaggttttatttgcttggctgtgtttcttgaagattctactgatgtcttcagtgatatgcatgcccccattaaagattctaaagcaaactactacacgtaggccatcatgttccaagtttttgaaagttcatctttttcatcttgttgataaatttcatcaacttttatgtagggaaaagtccggcatttacagaaggcttttgcttcaagagtagataaatccacacagactgaactactatgctatgatgctaccgtgataagctgctattctgctcatcacaaggagttagagtcctaattatttaaataaacagaaggaagaaaggaaggaaattaattttgacaaaggacctgaataatccataaaccagatgcctttagtgaaaacgaagtaagatcagctctggatacctcctaactcttcccctccttctcctgatgagggagaagtggaggcccaaggaaaatgagcaagttttgtaacaacacgaatggggaaggatgggaaagagaacagaatcggtggagggtttaaacttgaaaagactagagacagtacaaggagggagagaggtggcaaaatgtacccaggccctgtattgattaggaattttcaagttctggacataaagttttctctaagaagtgaatttcttctgtatatgttgtccttttttcaacatgtctccaaattggttgaagaaatatgttatgaattactgtattaaaggctgtggatcacataaatagagctctgtctcttcttaggta

SEQ ID NO: 121300 - DNA, 605 bp, Homo sapiens
  Payload ID: 3782
  Gene Symbol: CCSER1
  Gene Name: coiled-coil serine-rich protein 1
  ENST ID: ENST00000513522
  CDS Start-End: 1-508
gaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatgccctgtggaatcctacatgcactgaaggtttatttaaaccagtacttatttcaacttaggttaaatcattatctgacaataagaaatgcatcactaatctgtgacatgtaaaatattgagtaaaatcaattttttcatcatttcatattttaagta

SEQ ID NO: 121301 - DNA, 514 bp, Homo sapiens
  Payload ID: 3782
  Gene Symbol: CCSER1
  Gene Name: coiled-coil serine-rich protein 1
  ENST ID: ENST00000510519
  CDS Start-End: 225-401
tgaggacacagtgagaaggcagctatttgcaagccaggaagagagccatcaccaagaactgaatctgccagccccttcatcttggatttcccagcctccaaaactctacaagttagagttggattatctacattacgaagagaggaaagtgattgtaaaactagactttatttcattcagcaaaggaaattcattggcagggtgagactagtcgaagtgcagacatgagtccagcaagcagtaccacgtcacttcctgttagtcctcttactgaagagccagtgcctttcaagaatattcagcattatatcaactgtacacacatatggtctgacacatgccactgcatcattatagaagagccaaaggataaccaattttgcatagaccacataccctagggaattctgaaaacctgactaacatcaattgaagattggggttcaggaggcctagatgatccaccatgacttattcaaaagttgaagatgaaaggaaagaataaagactcttt

SEQ ID NO: 121302 - DNA, 5847 bp, Homo sapiens
  Payload ID: 3782
  Gene Symbol: CCSER1
  Gene Name: coiled-coil serine-rich protein 1
  Uniprot ID: Q9C0I3
  ENST ID: ENST00000509176
  CDS Start-End: 289-2991
gtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattgaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcatttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattggaacatgaaactgta

SEQ ID NO: 121303 - DNA, 716 bp, Homo sapiens
  Payload ID: 3782
  Gene Symbol: CCSER1
  Gene Name: coiled-coil serine-rich protein 1
  ENST ID: ENST00000508550
  CDS Start-End: 1-413
tagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttgggtctgcgacagatctctgaccatctgaatagatgcttcacaatttgcagcacagaattgaccttcagtaaactaactacctgttctgaggtgacagtcactggaatctgaggatgttttgaataatttgggatcttgtgaactggatgaagatgatctaatgcttgatcttgaatttttagaggaacagagtcttcacccttctgaactaccgcaggaacataccaggaaagccaagagaatccacagacctttgaaggaattggatcaccgccacaggctccctgagatggcaaaaaactgtgagtctgcttgctttctcaatgggaggctcgtggtccggggcaagttctcagttctggtcactggctgcttggaaaatagactcagtgctgttgtgggacacgatgggag

SEQ ID NO: 121304 - DNA, 744 bp, Homo sapiens
  Payload ID: 3782
  Gene Symbol: CCSER1
  Gene Name: coiled-coil serine-rich protein 1
  ENST ID: ENST00000502478
  CDS Start-End: 1-224
ttaggaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagttttcttcatgaatccagcattaatgtttcacttgtaaaacaactcacatacttttgtgtgattcgatgggctaaatccgacattaagaatttcaagctgcaacataacaggtatacagcagacggcaccctgcagaatctccaaggaatacttgagtcgtcagcgcttctgatgggttttggaaaaagacagtgagcagagaatcacttaagcaaagtggaaaagccgtaattgtgttcctctgagacacatttttactgaaattatgttttgtttttgtttgaaaatcagaatcaaaggcatatttaactacagttaaaatagctgtttttaatgagtgattctatcaaatatgatgttacaactttagataacataatgcaatttcttaaaagtagtatgaatctaataatattcacatgtttacagatgagcaaaagtgtttcagaatctagtgactcgtttagctggaatgcacttattccttaactgtatcattttaaccttgataaaattgaaaacttgtggaaa

SEQ ID NO: 121305 - DNA, 7664 bp, Homo sapiens
  Payload ID: 3783
  Gene Symbol: CCSER2
  Gene Name: coiled-coil serine-rich protein 2
  Uniprot ID: Q9H7U1
  ENST ID: ENST00000224756
  CDS Start-End: 186-2690
gcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaa

SEQ ID NO: 121306 - DNA, 2066 bp, Homo sapiens
  Payload ID: 3783
  Gene Symbol: CCSER2
  Gene Name: coiled-coil serine-rich protein 2
  Uniprot ID: Q9H7U1
  ENST ID: ENST00000359979
  CDS Start-End: 263-1966
ggcggagtccgggcgggcgccggccgagggagggggcgcggcggctttggagtccggcgctccctcaggccgcggacgcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagtatgtatggatttatatactcttggaatattttgtttaccctactatagagagacttgtgatatgattgattttgtaaaaaatttatgaattaactttactactttgagaaatggaaattcatatttgttaagagcctataaaatatctgactctaatatgaaataaagcatggagaatatatgacatt

SEQ ID NO: 121307 - DNA, 7657 bp, Homo sapiens
  Payload ID: 3783
  Gene Symbol: CCSER2
  Gene Name: coiled-coil serine-rich protein 2
  Uniprot ID: Q9H7U1
  ENST ID: ENST00000372088
  CDS Start-End: 260-3403
ggagtccgggcgggcgccggccgagggagggggcgcggcggctttggagtccggcgctccctcaggccgcggacgcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaagttc

SEQ ID NO: 121308 - DNA, 5888 bp, Homo sapiens
  Payload ID: 3783
  Gene Symbol: CCSER2
  Gene Name: coiled-coil serine-rich protein 2
  Uniprot ID: Q9H7U1
  ENST ID: ENST00000543283
  CDS Start-End: 125-910
agtgccttgggtacaactatgtctgagtaggcagccggtaacacaatgtctcccttgtgcaaagtaactctcttagtgagtgctcagatatgtgaggaaaaagtatttggtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaagttc

SEQ ID NO: 121309 - DNA, 835 bp, Homo sapiens
  Payload ID: 3784
  Gene Symbol: CHCHD1
  Gene Name: coiled-coil-helix-coiled-coil-helix domain containing 1
  Uniprot ID: Q96BP2
  ENST ID: ENST00000372833
  CDS Start-End: 14-370
agcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaacttggccttttgttgtgaattaggtactctcttcattcttgagcctcccctagaccctggaaattctttccttcctgatttgccctaggagcaggacaaataccgttgtattgtctttccctgcatttgaagtcttttacaccatttagtgcccttgcttttggatgcaataaggaagttgaagttgccttcgtctgtaaatacttagtgattgcctattttgtgcgtagtccctgcaaggtgctctctgaataataaagttaacaaactggtgaccta

SEQ ID NO: 121310 - DNA, 1202 bp, Homo sapiens
  Payload ID: 3784
  Gene Symbol: CHCHD1
  Gene Name: coiled-coil-helix-coiled-coil-helix domain containing 1
  ENST ID: ENST00000372837
  CDS Start-End: 30-323
cgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgtgatcttgacggatttattcattgctctgaactttcgagttactgtacgtaaaatgaggctaaccaataccaccttaaagaatgttgtgagtgtcagatgaagtaatgaatgggaaaatcattttgaaaaatgtaaattgctgctcaagtagacattattgtgtgaaatagaactaaagagactaaaactaaataatgacaatagtttggtttcctgtctaggcttaattgttagctgagatagtagcttctgaacatagtctcatttgtaggtcccaacgcccttttgttgaaaagaggctgacatagatctctccaggctggttaacatcttcatgtgctttagggcattgtgagaactatgggcctacatcaggacaaacttgattgattgattggttttttgggtcagatcttaaaagtctggactagacaaactgtagagctgtcattcttgtatttgttttgtgttttcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacag

SEQ ID NO: 121311 - DNA, 691 bp, Homo sapiens
  Payload ID: 3785
  Gene Symbol: CHCHD10
  Gene Name: coiled-coil-helix-coiled-coil-helix domain containing 10
  ENST ID: ENST00000401675
  CDS Start-End: 69-518
ggcatttgtccccgcgacagcaccgctgccgccgtctctaaggtcgcccgggtcccaccgccgccaccatgcctcggggaagccgcagcgcggcctcccggccagccagccgcccagccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcagcctcttgcactgtacccccaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 121312 - DNA, 1171 bp, Homo sapiens
  Payload ID: 3785
  Gene Symbol: CHCHD10
  Gene Name: coiled-coil-helix-coiled-coil-helix domain containing 10
  Uniprot ID: Q8WYQ3
  ENST ID: ENST00000484558
  CDS Start-End: 570-998
cagggccgcgcttcacttccctaggccaccggagactcccaggccacgcggtggtcagcagaccctgtctggagggaggggacagacagccgagtccgggagggggcagagagcggagtccagcctggagcctcgcgtccccttcccagctggccccatcccgtcgcctccccgtctcctctcccctccagggctcgcaacaacccccaactccgctccctgccctctgcggtggtcctaacagaaggcactgtcgccctccttaagccctcggcgctttgcgacactggcccctgtccccagaacccgcacagcctgccaggcgcagggagggagcagggtcccatttccagccgagacccggagctgctggaagggagatgtccggaggacgggagaagggggatagggttgggggcagtgccgcctcccgctgggggcgtgttcctgaggccccgcccggggccccgccttttttgcgccggctgtgacaagcgctgcggcatttgtccccgcgacagcaccgctgccgccgtctctaaggtcgcccgggtcccaccgccgccaccatgcctcggggaagccgcagcgcggcctcccggccagccagccgcccagccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 121313 - DNA, 494 bp, Homo sapiens
  Payload ID: 3785
  Gene Symbol: CHCHD10
  Gene Name: coiled-coil-helix-coiled-coil-helix domain containing 10
  ENST ID: ENST00000517886
  CDS Start-End: 47-346
ccgctgccgccgtctctaaggtcgcccgggtcccaccgccgccaccatgcctcggggaagccgcagcgcggcctcccggccagccagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacac

SEQ ID NO: 121314 - DNA, 384 bp, Homo sapiens
  Payload ID: 3785
  Gene Symbol: CHCHD10
  Gene Name: coiled-coil-helix-coiled-coil-helix domain containing 10
  ENST ID: ENST00000520222
  CDS Start-End: 3-170
ccatgcctcggggaagccgcagcgcggcctcccggccagccaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccaca

SEQ ID NO: 121315 - DNA, 691 bp, Homo sapiens; identical to SEQ ID NO: 121311
  Payload ID: 3785
  Gene Symbol: CHCHD10
  Gene Name: coiled-coil-helix-coiled-coil-helix domain containing 10
  ENST ID: ENST00000620558
  CDS Start-End: 69-518

SEQ ID NO: 121316 - DNA, 384 bp, Homo sapiens; identical to SEQ ID NO: 121314
  Payload ID: 3785
  Gene Symbol: CHCHD10
  Gene Name: coiled-coil-helix-coiled-coil-helix domain containing 10
  ENST ID: ENST00000631145
  CDS Start-End: 3-170

SEQ ID NO: 121317 - DNA, 494 bp, Homo sapiens; identical to SEQ ID NO: 121313
  Payload ID: 3785
  Gene Symbol: CHCHD10
  Gene Name: coiled-coil-helix-coiled-coil-helix domain containing 10
  ENST ID: ENST00000626041
  CDS Start-End: 47-346

SEQ ID NO: 121318 - DNA, 1171 bp, Homo sapiens; identical to SEQ ID NO: 121312
  Payload ID: 3785
  Gene Symbol: CHCHD10
  Gene Name: coiled-coil-helix-coiled-coil-helix domain containing 10
  Uniprot ID: Q8WYQ3
  ENST ID: ENST00000629095
  CDS Start-End: 570-998

SEQ ID NO: 121319 - DNA, 901 bp, Homo sapiens
  Payload ID: 3786
  Gene Symbol: CHCHD2
  Gene Name: coiled-coil-helix-coiled-coil-helix domain containing 2
  Uniprot ID: Q9Y6H1
  ENST ID: ENST00000395422
  CDS Start-End: 164-619
cttcaggcctgcggagacgacggagaacggaagttctctgcctgtgtgctggttggttgcgcgttgaggccagccccgcctcccatcttccggtctcctcagaagtcgcttagctcttcggtggttgtcccacgtccggaggcctagccgtcgcttacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggta

SEQ ID NO: 121320 - DNA, 1598 bp, Homo sapiens
  Payload ID: 3787
  Gene Symbol: CHCHD3
  Gene Name: coiled-coil-helix-coiled-coil-helix domain containing 3
  Uniprot ID: Q9NX63
  ENST ID: ENST00000262570
  CDS Start-End: 146-829
cgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 121321 - DNA, 1570 bp, Homo sapiens
  Payload ID: 3787
  Gene Symbol: CHCHD3
  Gene Name: coiled-coil-helix-coiled-coil-helix domain containing 3
  ENST ID: ENST00000448878
  CDS Start-End: 118-816
gccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggtgagtattaaaaatgctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatat

SEQ ID NO: 121322 - DNA, 559 bp, Homo sapiens
  Payload ID: 3787
  Gene Symbol: CHCHD3
  Gene Name: coiled-coil-helix-coiled-coil-helix domain containing 3
  ENST ID: ENST00000457942
  CDS Start-End: 152-343
gaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagttcccctaaggacccctacctgataacacttttaagactggatccagcctttctttgcggaatcaccatggcggctgggaccctgtacacgtatcctgaaaactggagggccttcaaggctctcatcgctgctcagtacagcggggctcagatccgcgtgctctccgcaccaccccacttccattttggccaaaccaaccgcacctctgaatttcttcgcaaatttcctgccggcaagg

SEQ ID NO: 121323 - DNA, 1310 bp, Homo sapiens
  Payload ID: 3787
  Gene Symbol: CHCHD3
  Gene Name: coiled-coil-helix-coiled-coil-helix domain containing 3
  ENST ID: ENST00000423635
  CDS Start-End: 134-859
gcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgagaagaaacttcagaaacagcattaagaaagttttgtgtgcagtcttttagcagcaactttttggagtcacagaacatgtatacgttattactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagtttggtgaaatgaaatatcacaaaacaggactctttattttgttacctcttgtcccagtatggctcctagtaggagaactcgttacttctccctcatttcaggcaacctgagcaccagtgaaactgtgactggcatttgcagggacctaaaaggcttactcagtgccagacactgtgtggagagcttaaacgttatcttactaatcttcacaacaatgttaaacagtaggaaatgaggaaaaatttgcatcttagagagatcaagaaacttgcccaagcttccactgcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccac

SEQ ID NO: 121324 - DNA, 1603 bp, Homo sapiens
  Payload ID: 3788
  Gene Symbol: CHCHD4
  Gene Name: coiled-coil-helix-coiled-coil-helix domain containing 4
  Uniprot ID: Q8N4Q1
  ENST ID: ENST00000295767
  CDS Start-End: 326-793
agtttccggctgaggttggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctga

SEQ ID NO: 121325 - DNA, 1405 bp, Homo sapiens
  Payload ID: 3788
  Gene Symbol: CHCHD4
  Gene Name: coiled-coil-helix-coiled-coil-helix domain containing 4
  Uniprot ID: Q8N4Q1
  ENST ID: ENST00000396914
  CDS Start-End: 183-611
aggttggcctggccgcggttgcgagggcgccgaggcaggcgcgcggcgggcaggcctgggagggggcgggtccgcgcgggcttcggaggagcccgccctgccagaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaa

SEQ ID NO: 121326 - DNA, 584 bp, Homo sapiens
  Payload ID: 3788
  Gene Symbol: CHCHD4
  Gene Name: coiled-coil-helix-coiled-coil-helix domain containing 4
  ENST ID: ENST00000420103
  CDS Start-End: 74-175
agggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagatcctgtggtctctgtaaaatggagataaagtaatacccaccagtgaactcacagatgtaataaaacacattgcatgggacaaaaatgtgtaaaagatacagctgttactgttctactttcgatccagtgtgaactgtgctgcaagggaaaatgtccaggaaggcacatggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggg

SEQ ID NO: 121327 - DNA, 691 bp, Homo sapiens
  Payload ID: 3789
  Gene Symbol: CHCHD5
  Gene Name: coiled-coil-helix-coiled-coil-helix domain containing 5
  Uniprot ID: Q9BSY4
  ENST ID: ENST00000324913
  CDS Start-End: 208-540
gtggctactcagggcgccgccatgacgagccgggccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccacgcccctcccctgcagagtggccagatggagtcctgagccctggacatgggcccggctttcctggatatcaggacttccaataaataaagactctgtatactggg

SEQ ID NO: 121328 - DNA, 3272 bp, Homo sapiens
  Payload ID: 3789
  Gene Symbol: CHCHD5
  Gene Name: coiled-coil-helix-coiled-coil-helix domain containing 5
  Uniprot ID: Q9BSY4
  ENST ID: ENST00000409719
  CDS Start-End: 54-530
ggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccacccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggtaagaggggctcacctcagttcatctcttttctccataacatccccttcatccttctggttgttcagggtaaagactttggagtcatcctcagccccaccccatcaccacacaggcctttgccatgcatccagaatccagaacatcatcacttcttgccccatatagcccctgctttaatccaccaccaccctcaccctccacctccaggatacctgccccagccttctccctggtctcccttcctccctcttttcttgcctccataaagcggcctgggtgagcatgtaaggactgaaatctggtctcatcacacctatgcttaaagctctccagtggctttgtgtcacattgagaacaaaagtccaggtccttgctgggttctctgtgttcttccctaggctgacttcatctgcctcctgcctcaccctctctcttctttctcactactcctcatctgcaactgcagaggggctgggctggggtggccaaaaaaaggtcactcttttaaatgtatctaatatgtaaaccagatatacagtatatctgtgatatgtaagtttcatggttgggcaattagaacaaaagtctaaaatgactccttgaggagaggcagtaacggaaaaaggttgaaaaatgctcttttagatgtttactaccctcctcactggactgtgagctccaaaggtgaaagtcacatctttccccagcccctgtgagtaccctctcctggggccctctctctgcccctgcagccctggcttctctcttgggccacctggccatccttctcctgggccccatgctccatcttgactttccagtcattcttggtgatcatcctagactgatctcagaggaaatctgaccatgttctgcttctacttacaaacctttccatggttctcaattccaccagcccaagtcttaatgccagcacagcccacagggccctgtgggatgcagtccctgcgacccgtggtcccacctctcctctctttcccccttaagctctatgttccagccccagtgaacatgcagttactcaagtgcacgtctccgctgcttttgtccagctgtttccctctgctgggactgcccttcctaatccatctcctggctaattcctattccagcttagacggcacgtctctcagaaaacctccctgatgtcccacccacttcccgcccctgtcttcaagttcccaaggtccctgagcccctccatcaaggctcacatcctatgcctgtgtcaagggagctcttggctgaagattggggtgatgcccttcttaccaggccctataggcattaattgtttctgtaaggcaaggataagtgaatagttcagacccctagggcagaaactacgacccctgagagccggaaggaacttaattctcctcaggaaacgttacctaacgatcacatactgttctcagtcagctgctggggacatttctgtctttcaagttttttgggcatctgaacagtaaagaccccatcctcctatcttagagccatttgctgcttccctccctggaccagcaaccagcctctctctggtctccttgtggccacccctgccctgacagtcttctcttccctggcagccaaagaagcttttaaaaatgggaattagggccgggtgcggtggcacatgcctgtaatcccagcacttggggaggccgaggtgggtggatcacctgaggtcaggagtttgagaccagcctggccaacatggtgaaaccccatctctactaaaaatacaaatattagccaggtgtggtggcaggtacctgtaatcccagctacttgggaggctgaggcaggagaattgcttgaacccaggaggcagaggttgcagtgagccaagattgcaccattgcactctagcctgggcgatagagcgagactctgtcttccaaaaaaaaaaaaaaaagggaattaggtcacatctcctcatcatcccctccttcctggggatggcatcccagttacagtttttccttcctagctaggggcagtgagatttgttgtctggtctacacaatagcgaacacaaacattctcatctcctgcagcatggcatacagactttacagaatgtcctgtgtttttgtggctgacaatcaaagtggtacatgtccctcccattccgcacacacctctgctctttaccctgattaaattttcttcatcgaatttcttggatgttgacatatttattgtccgtctctccctgcttgagtcagagagttttgcctgctgggtacacggcaggtgctcagtaaatatagcagaatggcgcgttccctgcctcccatgacacttcaccacagctgactttttcacatggctcagggccaaggtcattgcccaacacccttctccctccagactgtgggctctgcagggtctccctctgtggtgtctacataggctccccaggctgggcacagaggaggtgctactagatgttgatgtactttctccacaggcacagccacttcctgcctcctgaggactcctctgacggcaggaaaactggacatgaatgactgcccccacgcccctcccctgcagagtggccagatggagtcctgagccctggacatgggcccggctttcctggatatcaggacttccaataaataaagactctgtatactgggctttgattcctgccatccgtacctgagagggtcctaggagagctggctgggcagagtcatctgttccccagcttcaccgggtgtgccaaggaagtgcctgggaagaacaggactctgcagctgtgccccagggttgagactaccctgcctcccttgtgaactctgccacacagccatttcctgacttctgctgcatgtgcctggggtaaagaccctcaatcccttccactctagc

SEQ ID NO: 121329 - DNA, 748 bp, Homo sapiens
  Payload ID: 3789
  Gene Symbol: CHCHD5
  Gene Name: coiled-coil-helix-coiled-coil-helix domain containing 5
  ENST ID: ENST00000454841
  CDS Start-End: 180-326
gccgggccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggccaagccggaatcctggcagcgggactgtcactaccttaagatgagcattgcccagtgcacatcctcccagtgagtgcgggcaagtatgagacagtgtggggggtgggcagtggggtgggaatctcccaggggctgaactgccctacccccacagcccaatcatccgccagatccgccaggcctgtgctcagccttttgaggccttcgaggagtgtcttcgacagaacgaggcagctgtgggcaactgtgcagagcatatgcgccgcttcctgcagtgcgctgagcaggtgcagccgccacgctcacctgcaactgtggaggcacagccacttcctgcctcctgaggactcctctgacggcaggaaaactggacatgaatgactgcccccacgcccctcccctgcagagtggccagatggagtcctgagccctggacatgggcccggctttcctggatatcaggacttccaataaataaagactctgtatactggg

SEQ ID NO: 121330 - DNA, 1006 bp, Homo sapiens
  Payload ID: 3790
  Gene Symbol: CHCHD6
  Gene Name: coiled-coil-helix-coiled-coil-helix domain containing 6
  Uniprot ID: Q9BRQ6
  ENST ID: ENST00000290913
  CDS Start-End: 94-801
cgcggccgcgcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcagtcgttga

SEQ ID NO: 121331 - DNA, 690 bp, Homo sapiens
  Payload ID: 3790
  Gene Symbol: CHCHD6
  Gene Name: coiled-coil-helix-coiled-coil-helix domain containing 6
  ENST ID: ENST00000513253
  CDS Start-End: 1-500
ccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaaggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgccttt

SEQ ID NO: 121332 - DNA, 1159 bp, Homo sapiens
  Payload ID: 3790
  Gene Symbol: CHCHD6
  Gene Name: coiled-coil-helix-coiled-coil-helix domain containing 6
  ENST ID: ENST00000508789
  CDS Start-End: 73-843
aagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctgcaggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaaggtaaggccttgcctgcctcccaggtttccaagggccttgggaggtaggcgaggtacctctatctagcattggagatctctgcctgccttttcctgttagaatcagatgctccacttggaggtctctgcatttgccaagggagggattcttcgctttcctcagtcacctgcacactctcctggctgcttccaggagcgccttggacatctggccccagggagatgatccctgttgcgtttgccctattaggctgggtgggagcaggctgggtaaagtcaggccccaccttcaagggccgggccccttgtgggtgccggggacttcttagccctcggcacttaggggtgggagggtggcagaggcccgagtgcagagtgggggt

SEQ ID NO: 121333 - DNA, 1148 bp, Homo sapiens
  Payload ID: 3790
  Gene Symbol: CHCHD6
  Gene Name: coiled-coil-helix-coiled-coil-helix domain containing 6
  ENST ID: ENST00000503119
  CDS Start-End: 74-496
aaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctgataatacattgacatgattcaaaagtccaaaggtatccaataaaaaggctccatcactccaatcttccagccgcctggctccctgccttgggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaaggtaaggccttgcctgcctcccaggtttccaagggccttgggaggtaggcgaggtacctctatctagcattggagatctctgcctgccttttcctgttagaatcagatgctccacttggaggtctctgcatttgccaagggagggattcttcgctttcctcagtcacctgcacactctcctggctgcttccaggagcgccttggacatctggccccagggagatgatccctgttgcgtttgccctattaggctgggtgggagcaggctgggtaaagtcaggcc

SEQ ID NO: 121334 - DNA, 1684 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000303759
  CDS Start-End: 172-504
gctacttaaggtcctgctgcgtgagccattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttcc

SEQ ID NO: 121335 - DNA, 1535 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000355315
  CDS Start-End: 100-357
cgctacttaaggtcctgctgcgtgagccattgacgtgtttggagctggagacggcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcattt

SEQ ID NO: 121336 - DNA, 1550 bp, Homo sapiens
  Payload ID: 3791
  Gene Symbol: CHCHD7
  Gene Name: coiled-coil-helix-coiled-coil-helix domain containing 7
  ENST ID: ENST00000396723
  CDS Start-End: 177-461
ctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtc

SEQ ID NO: 121337 - DNA, 442 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000519367
  CDS Start-End: 107-277
gaaaaacacgttcaagtttttattcacaaagtacagagaatacatgaagttcctcactaagtgatcattatgccaaaatcaaaatttcagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaa

SEQ ID NO: 121338 - DNA, 1670 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000518801
  CDS Start-End: 149-355
gctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 121339 - DNA, 1805 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000523975
  CDS Start-End: 149-442
gctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaattcttttgatttgtattgactgctataaaaatgatggattaaaataggaccagaaaagaatgaatgcctacctgtgtaagaagtatttttgtatttttaagcacacttgttaaagggcttggaattttaatgtcactcctttgaaggtacataccaatatcaacattcatcttgtaact

SEQ ID NO: 121340 - DNA, 559 bp, Homo sapiens
  Payload ID: 3791
  Gene Symbol: CHCHD7
  Gene Name: coiled-coil-helix-coiled-coil-helix domain containing 7
  ENST ID: ENST00000523667
  CDS Start-End: 187-384
gtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgagccgtgaaagatccttgagagctcttgttagctgcctcgtcgtcctctaagctataagaatgcagttttaatatagaattctatcgtgatgcagagaagaaagaacggagtgaagccatttatgcctacggcagcagaaagagatgaaatcttgagagcagtgggaaatatgccc

SEQ ID NO: 121341 - DNA, 536 bp, Homo sapiens
  Payload ID: 3791
  Gene Symbol: CHCHD7
  Gene Name: coiled-coil-helix-coiled-coil-helix domain containing 7
  ENST ID: ENST00000517636
  CDS Start-End: 403-536
gtgtttggagctggagacggcctgggtgctggcgaagcggaggccggaggtgagtggttcccccgccctacctccgaagcggccgcagaaaagcggggagagaggggtgcccttgggccgtagcggggcccgaatgcacttctgcggcgcggaggcgctcccgccaggcttcgccgcagcgcggacctcttcccgttgctcttcctcccgccacacgggtctgttcgctccgggggcgaggaagatgacctctgcctagtccgggcaaccccagctcttcttccactctcctgtgtagcctctgaagcgcagttaccggccccacccccagttccctgcgttttcctcgccccttgtctctctcggcatggtctcggcacagcaagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaa

SEQ ID NO: 121342 - DNA, 573 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000521831
  CDS Start-End: 169-339
agtctggcggcggcgcgcgccgattgggcgggctgccgccggggagcgggggcagcaagttgggatgcgcgctacttaaggtcctgctgcgtgagccattgacgtgtttggagctggagacggcctgggtgctggcgaagcggaggccggagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagacc

SEQ ID NO: 121343 - DNA, 580 bp, Homo sapiens
  Payload ID: 3791
  Gene Symbol: CHCHD7
  Gene Name: coiled-coil-helix-coiled-coil-helix domain containing 7
  ENST ID: ENST00000517933
  CDS Start-End: 66-248
gtgtttggagctggagacggcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctgggtaagcctagattggttagctttgtgttaaaacccatctcctagggttgaaactgaagcctaaaattagtcagtacccacaatcctttcccactgatggctgtagggaaacttaacttttcaactttatcctctgtgtgctactttagccgtgaaagatccttgagagctcttgttagctgcctcgtcgtcctctaagctataagaatgcagttttaatataggtgggtcttcttagacatttaagtatctgcagccctaaaacaatgtctttgttataaatttagttttcctggagatgaacagaatgtttaacttcccttgtcataacacatcatgttaggcttcaatttctgccttttt

SEQ ID NO: 121344 - DNA, 703 bp, Homo sapiens
  Payload ID: 3791
  Gene Symbol: CHCHD7
  Gene Name: coiled-coil-helix-coiled-coil-helix domain containing 7
  Uniprot ID: Q9BUK0
  ENST ID: ENST00000521524
  CDS Start-End: 137-343
ctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaa

SEQ ID NO: 121345 - DNA, 567 bp, Homo sapiens
  Payload ID: 3791
  Gene Symbol: CHCHD7
  Gene Name: coiled-coil-helix-coiled-coil-helix domain containing 7
  ENST ID: ENST00000523532
  CDS Start-End: 187-384
gtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggccgtgaaagatccttgagagctcttgttagctgcctcgtcgtcctctaagctataagaatgcagttttaatatagaattctatcgtgatgcagagaagaaagaacggagtgaagccatttatgcctacggcagcagaaagagatgaaatcttgagag

SEQ ID NO: 121346 - DNA, 552 bp, Homo sapiens
  Payload ID: 3791
  Gene Symbol: CHCHD7
  Gene Name: coiled-coil-helix-coiled-coil-helix domain containing 7
  ENST ID: ENST00000521982
  CDS Start-End: 187-372
gtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggccgtgaaagatccttgagagctcttgttagctgcctcgtcgtcctctaagctataagaatgcagttttaatatagaattctatcgtgatgcagagaagaaagaacggagtgaagccatttatgcctacggcagcagaaagagatgaaatcttgagagcagtgggaaatatgccctattgaatgttt

SEQ ID NO: 121347 - DNA, 557 bp, Homo sapiens
  Payload ID: 3791
  Gene Symbol: CHCHD7
  Gene Name: coiled-coil-helix-coiled-coil-helix domain containing 7
  ENST ID: ENST00000523061
  CDS Start-End: 47-187
gcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttg

SEQ ID NO: 121348 - DNA, 2650 bp, Homo sapiens
  Payload ID: 3792
  Gene Symbol: COIL
  Gene Name: coilin
  Uniprot ID: P38432
  ENST ID: ENST00000240316
  CDS Start-End: 36-1766
tggtatctctcggcttccgttgagcaccaagcaagatggcagcttccgagacggttaggctacggcttcaatttgattacccgccgccagctaccccgcactgtacggccttctggcttctggtcgacttgaacagatgccgagtcgtcacagatctcattagtctcatccgccagcgcttcggcttcagttctggggccttcctaggcctctacctggagggggggctcttgccccccgccgagagcgcgcgccttgtgagagacaacgactgcctcagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgaatcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccagaatccagtagagacacccaagaaggactatagtctgttaccactgttagcagctgcccctcaagttggagaaaagattgcatttaagcttttggagctaacatccagttactctcctgatgtctctgactacaaggaaggaagaatattaagccacaatccagagacccagcaagtagatatagaaattctttcatccttacctgccttgagagaacctgggaaatttgatttagtttatcacaatgaaaatggagccgaggtagtggagtacgctgtgacacaggagagcaagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaacatctctaccga

SEQ ID NO: 121349 - DNA, 466 bp, Homo sapiens
  Payload ID: 3792
  Gene Symbol: COIL
  Gene Name: coilin
  ENST ID: ENST00000573008
  CDS Start-End: 354-466
aggtgcgcggcgcagggagcgggacggccgggtgggcggcgggcgggggacgcgcctgcgcacgcccgggcctgaagccgctagacctgctttgttgatgctcttgagagcatcagccaagacattcatgtgcaccactgtggtggtatggaaagagccagcgtaattttaaccagatatctggacgtccaatagcccggacaaattgatacataaaattaagcttcacagagtgttgtggaattgtacagatggctgtcactaccctagagaacataaattgtttagtattcacctaaattaaaacaggagtaaaatcttattaaagaaagaagcccacattctgaaacaaaatggataatcagcattatcaccttttaggagttaaattagaagagagaggagttgctgagaattctgtagtcatcagtaatggtgacattaatttatctcttagaaaagcaaa

SEQ ID NO: 121350 - DNA, 1328 bp, Homo sapiens
  Payload ID: 3793
  Gene Symbol: CIRBP
  Gene Name: cold inducible RNA binding protein
  Uniprot ID: Q14011
  ENST ID: ENST00000320936
  CDS Start-End: 81-599
tcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121351 - DNA, 584 bp, Homo sapiens
  Payload ID: 3793
  Gene Symbol: CIRBP
  Gene Name: cold inducible RNA binding protein
  ENST ID: ENST00000444172
  CDS Start-End: 1-177
cggagtcagagtggtggctacagtgaccggagctcgggcgggtcctacagagacagttatgacagttacgaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcaccca

SEQ ID NO: 121352 - DNA, 1606 bp, Homo sapiens
  Payload ID: 3793
  Gene Symbol: CIRBP
  Gene Name: cold inducible RNA binding protein
  Uniprot ID: Q14011
  ENST ID: ENST00000413636
  CDS Start-End: 86-877
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121353 - DNA, 905 bp, Homo sapiens
  Payload ID: 3793
  Gene Symbol: CIRBP
  Gene Name: cold inducible RNA binding protein
  ENST ID: ENST00000590171
  CDS Start-End: 62-244
ggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagacctctctcccctgcacagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaag

SEQ ID NO: 121354 - DNA, 830 bp, Homo sapiens
  Payload ID: 3793
  Gene Symbol: CIRBP
  Gene Name: cold inducible RNA binding protein
  ENST ID: ENST00000591376
  CDS Start-End: 70-309
gaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaagccgagtctgtggttcaggggggtctgtcggcggagcggggccactggaagaaaagcctgcggacctcgg

SEQ ID NO: 121355 - DNA, 938 bp, Homo sapiens
  Payload ID: 3793
  Gene Symbol: CIRBP
  Gene Name: cold inducible RNA binding protein
  ENST ID: ENST00000586636
  CDS Start-End: 71-577
ggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaagccgagtctgtggttcaggggggtctgtcggcggagcggggccactggaagaaaagcctgcggacctcgg

SEQ ID NO: 121356 - DNA, 1092 bp, Homo sapiens
  Payload ID: 3793
  Gene Symbol: CIRBP
  Gene Name: cold inducible RNA binding protein
  ENST ID: ENST00000587323
  CDS Start-End: 92-985
ccctcactcgcgcgttaggaggctcgggtcgttgtggtgcgctgtcttcccgcttgcgtcagggacctgcccgactcagtgtgtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccact

SEQ ID NO: 121357 - DNA, 3028 bp, Homo sapiens
  Payload ID: 3793
  Gene Symbol: CIRBP
  Gene Name: cold inducible RNA binding protein
  ENST ID: ENST00000587169
  CDS Start-End: 83-322
actcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 121358 - DNA, 532 bp, Homo sapiens
  Payload ID: 3793
  Gene Symbol: CIRBP
  Gene Name: cold inducible RNA binding protein
  ENST ID: ENST00000589686
  CDS Start-End: 87-532
cctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtgg

SEQ ID NO: 121359 - DNA, 619 bp, Homo sapiens
  Payload ID: 3793
  Gene Symbol: CIRBP
  Gene Name: cold inducible RNA binding protein
  ENST ID: ENST00000588411
  CDS Start-End: 305-619
ccgagggtctgacggctgcggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgt

SEQ ID NO: 121360 - DNA, 1013 bp, Homo sapiens
  Payload ID: 3793
  Gene Symbol: CIRBP
  Gene Name: cold inducible RNA binding protein
  ENST ID: ENST00000588230
  CDS Start-End: 86-979
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatgg

SEQ ID NO: 121361 - DNA, 1303 bp, Homo sapiens
  Payload ID: 3793
  Gene Symbol: CIRBP
  Gene Name: cold inducible RNA binding protein
  Uniprot ID: Q14011
  ENST ID: ENST00000586472
  CDS Start-End: 56-574
cgacgccccgcaggggaggaggcccgggaggagtatcagggtgcaggaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121362 - DNA, 1081 bp, Homo sapiens
  Payload ID: 3793
  Gene Symbol: CIRBP
  Gene Name: cold inducible RNA binding protein
  ENST ID: ENST00000587896
  CDS Start-End: 81-974
tcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccact

SEQ ID NO: 121363 - DNA, 870 bp, Homo sapiens
  Payload ID: 3793
  Gene Symbol: CIRBP
  Gene Name: cold inducible RNA binding protein
  Uniprot ID: Q14011
  ENST ID: ENST00000585630
  CDS Start-End: 213-731
ccaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaa

SEQ ID NO: 121364 - DNA, 571 bp, Homo sapiens
  Payload ID: 3793
  Gene Symbol: CIRBP
  Gene Name: cold inducible RNA binding protein
  ENST ID: ENST00000592234
  CDS Start-End: 1-220
tctgaaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgcctatggaagctgcagccctcggaggacagaagtgttgtgcgcccaacagaaccctctgagacgcaagctgctcccttggctagctcatatgtggaaatagccctgtaattcgaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 121365 - DNA, 1459 bp, Homo sapiens
  Payload ID: 3793
  Gene Symbol: CIRBP
  Gene Name: cold inducible RNA binding protein
  Uniprot ID: Q14011
  ENST ID: ENST00000588090
  CDS Start-End: 212-730
aaacgccgcggacggagcgaggccgcagcgccccctggtgtccgcaacgggcagcgcgtcccggtcgggtcccgcatggtcagtggccagcaggggtggatgaaggggtcccagccgcctgagacccccggtggggacacaggatcgcggtgagatacctgggagtcacgggtgctcgcagacgcagctgaccccagaggcacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121366 - DNA, 928 bp, Homo sapiens
  Payload ID: 3793
  Gene Symbol: CIRBP
  Gene Name: cold inducible RNA binding protein
  ENST ID: ENST00000591055
  CDS Start-End: 70-477
gaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaaggtgaggatcagggtgctgagcaggagtcccgtctcgaggatggggcacccacctgctaacccgtcccgccctctgtctccagtctgtagatggacggcagatccgagtagaccaggcaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggcccc

SEQ ID NO: 121367 - DNA, 370 bp, Homo sapiens
  Payload ID: 3793
  Gene Symbol: CIRBP
  Gene Name: cold inducible RNA binding protein
  ENST ID: ENST00000588344
  CDS Start-End: 1-270
gatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccagcccctgcgtccatctgtgctgtgcgccccacagtagacgtgcagacgtccctgagaggttcttgaagatgtttatttatattgtccttttttactggaagacgtacgcatactccatcgatgttgtatttgcagtg

SEQ ID NO: 121368 - DNA, 1734 bp, Homo sapiens
  Payload ID: 3793
  Gene Symbol: CIRBP
  Gene Name: cold inducible RNA binding protein
  ENST ID: ENST00000586548
  CDS Start-End: 112-590
acagatgcaaagcggcaggtgtgcgcaggtgcgtgtcaacgccaccctgggaacccaggatggctgcggacactcacggagcccgcacccaggaacccgctcgtagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121369 - DNA, 1835 bp, Homo sapiens
  Payload ID: 3793
  Gene Symbol: CIRBP
  Gene Name: cold inducible RNA binding protein
  ENST ID: ENST00000589710
  CDS Start-End: 213-1106
ccaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121370 - DNA, 334 bp, Homo sapiens
  Payload ID: 3793
  Gene Symbol: CIRBP
  Gene Name: cold inducible RNA binding protein
  ENST ID: ENST00000592815
  CDS Start-End: 220-334
gggtcccgcatggtcagtggccagcaggggtggatgaaggggtcccagccgcctgagacccccggtggggacacaggatcgcggtgagatacctgggagtcacgggtgctcgcagacgcagctgaccccagaggcacaggtaccgacacaggtccacacctggaagccggtgcacagtgctcggcacagatgcaaagcggcaggtgtgcgcaggccgccatggcatcagatgaaggcaaactttttgttggagggctgagttttgacaccaatgagcagtcgctggagcaggtcttctcaaagtacggacagatctctgaagtggtggttgtga

SEQ ID NO: 121371 - DNA, 616 bp, Homo sapiens
  Payload ID: 3793
  Gene Symbol: CIRBP
  Gene Name: cold inducible RNA binding protein
  ENST ID: ENST00000589266
  CDS Start-End: 375-616
actctgactgatccccgcgcctcgccgggcaggggcgagccccgcgcgtcgggcccggaatagcagtctcgcccccgcccggcgcggctattttgagctcctccgttggggccgaggcgcgggggcggcgggaggctgggggtcgacacgcaggctgcgtcctcgccccgcgagattggacccctcgaggactgtgcgctgtggccgcgcagggctgggcggcggggccccctctcccacgcgaggcgtctgcgtggagcggcggcaccgggagcccggccgctcgagccaaacgccgcggacggagcgaggccgcagcgccccctggtgtccgcaacgggcagcgcgtcccggtcgggtcccgcatggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagacca

SEQ ID NO: 121372 - DNA, 3117 bp, Homo sapiens
  Payload ID: 3793
  Gene Symbol: CIRBP
  Gene Name: cold inducible RNA binding protein
  ENST ID: ENST00000590347
  CDS Start-End: 85-492
tcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaaggtgaggatcagggtgctgagcaggagtcccgtctcgaggatggggcacccacctgctaacccgtcccgccctctgtctccagtctgtagatggacggcagatccgagtagaccaggcaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 121373 - DNA, 833 bp, Homo sapiens
  Payload ID: 3793
  Gene Symbol: CIRBP
  Gene Name: cold inducible RNA binding protein
  ENST ID: ENST00000585913
  CDS Start-End: 39-545
tcacggagcccgcacccaggaacccgctcgtagccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 121374 - DNA, 746 bp, Homo sapiens
  Payload ID: 3793
  Gene Symbol: CIRBP
  Gene Name: cold inducible RNA binding protein
  ENST ID: ENST00000591935
  CDS Start-End: 71-577
ggatcgcggtgagatacctgggagtcacgggtgctcgcagacgcagctgaccccagaggcacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccc

SEQ ID NO: 121375 - DNA, 650 bp, Homo sapiens
  Payload ID: 3793
  Gene Symbol: CIRBP
  Gene Name: cold inducible RNA binding protein
  ENST ID: ENST00000593048
  CDS Start-End: 82-321
ctcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttct

SEQ ID NO: 121376 - DNA, 1073 bp, Homo sapiens
  Payload ID: 3793
  Gene Symbol: CIRBP
  Gene Name: cold inducible RNA binding protein
  ENST ID: ENST00000589235
  CDS Start-End: 68-574
ggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccatggcgggcgcctttcggtgtgtgttgggtgcagggcagcgcctcccgggagcgccgggtcccccgcctggagcccgcgcctgttctccctcccttcctcctccttccaggaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaa

SEQ ID NO: 121377 - DNA, 532 bp, Homo sapiens
  Payload ID: 3793
  Gene Symbol: CIRBP
  Gene Name: cold inducible RNA binding protein
  ENST ID: ENST00000592412
  CDS Start-End: 148-387
cctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttat

SEQ ID NO: 121378 - DNA, 1052 bp, Homo sapiens
  Payload ID: 3793
  Gene Symbol: CIRBP
  Gene Name: cold inducible RNA binding protein
  ENST ID: ENST00000585914
  CDS Start-End: 66-674
ctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggttgaaggggcccggccaggactcggggaagggtggcctgagagcagcgatgacctctggggtcactgtcccaggagggacttcacctggaacaagagctggaggcagccgcttgcccaggaggcttgtcccctgtaagaggcgcttcgccagtgaggtgcgggctcagggcctcgagtctctcctggagcacgggctgcggtgcgccggcagcttacggggcggccagtccttgcccacaacgatgtggagccctgtgaaag

SEQ ID NO: 121379 - DNA, 573 bp, Homo sapiens
  Payload ID: 3793
  Gene Symbol: CIRBP
  Gene Name: cold inducible RNA binding protein
  ENST ID: ENST00000592051
  CDS Start-End: 478-573
ctttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccaggccgccatggcatcagatgaaggcaaactttttgttggagggctgagttttgacaccaatgagcagtcgctggagcaggtcttctcaaagtacggacagatc

SEQ ID NO: 121380 - DNA, 587 bp, Homo sapiens
  Payload ID: 3793
  Gene Symbol: CIRBP
  Gene Name: cold inducible RNA binding protein
  ENST ID: ENST00000591659
  CDS Start-End: 67-587
gctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtcccttggggatgctgtgaggtactgctggtgggagctggtactcactttttcctgtatgtgcaggaggaggggaccgaggctatggggggaaccggttcgagtccaggagtgggggctacggaggctccagagactactatagcaggtgaggg

SEQ ID NO: 121381 - DNA, 1507 bp, Homo sapiens
  Payload ID: 3793
  Gene Symbol: CIRBP
  Gene Name: cold inducible RNA binding protein
  ENST ID: ENST00000591097
  CDS Start-End: 86-268
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagacctctctcccctgcacagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcaggtgagggggaggccggcccaagcacaggggtggttgcgggatggccagcttccgtcccgggtcccaggtccctgggggagctgagatgagactggctgggcaaggagcagaggcaggtggggacccaggccaagaggagaggagactgctcaggacattcgcagaagcgggagggcctgggggacaggctggtggagattttgaacaatttccaagatgctgccctgctggggtccttgttgtgtccccagaagggacggctggcatgggggctggcggctcagcctgttgtggcagagcagaagtagacgggtaccttccggtactcaacgtttgtctgtcttgcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacg

SEQ ID NO: 121382 - DNA, 942 bp, Homo sapiens
  Payload ID: 3793
  Gene Symbol: CIRBP
  Gene Name: cold inducible RNA binding protein
  ENST ID: ENST00000586773
  CDS Start-End: 152-658
cccccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggttgaaggggcccggccaggactcggggaagggtggcctgagagcagcgatgacctctggggtcactgtcccaggagggacttcacctggaacaagagctggaggcagccgcttgcccaggaggcttgtcccctgtaagtgctttcgggaagagtggcatgtggcgctgagccctgtcccgggcggcacctgggcgtttcagtgagtcctgctctcccgcacctatggccccatggcgggcgcctttcggtgtgtgttgggtgcagggcagcgcctcccgggagcgccg

SEQ ID NO: 121383 - DNA, 1509 bp, Homo sapiens
  Payload ID: 3793
  Gene Symbol: CIRBP
  Gene Name: cold inducible RNA binding protein
  Uniprot ID: Q14011
  ENST ID: ENST00000588030
  CDS Start-End: 262-780
aagtcccttagggtgtggggcgagggcctgcctgcctgcttcgtggcctgggcaggaccctggccccctcaggacctgccagtatgggggagacgcgaccaccagctctccccagccacaggagtcggggactcccactctgccacacccacctgctccccttcctggagtctcacatctgtgtggcttgctgcagggagatcaccaggccgactgggaggacctaggactccgcagggtaccttgggctggcaggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 121384 - DNA, 1043 bp, Homo sapiens
  Payload ID: 3793
  Gene Symbol: CIRBP
  Gene Name: cold inducible RNA binding protein
  ENST ID: ENST00000628979
  CDS Start-End: 150-1043
aggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaa

SEQ ID NO: 121385 - DNA, 2777 bp, Homo sapiens
  Payload ID: 3794
  Gene Symbol: CSDC2
  Gene Name: cold shock domain containing C2, RNA binding
  Uniprot ID: Q9Y534
  ENST ID: ENST00000306149
  CDS Start-End: 545-1006
tcagcagctgccctcactgggcagggcaaattataccgtggcccgaccataaaagccactttccaaaaaaagaagctttaaggcccccgagagacgcagctgagcctctcacctggcagtgcctgactcaggaggtgatgtctgggccatgagccacagagcctggtgtccctttaagcagggagtacaaattctcatccctccctcctgctctccctgacgtcagctggaaggcgtgtgagtgagtgaggggctgaggtaccgcccgcgcgagcacacacagacacacacacacacacacacacacacacacacacacatcttccagacccatcccctgcctgccagctccacgagccagagagagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccac

SEQ ID NO: 121386 - DNA, 721 bp, Homo sapiens
  Payload ID: 3794
  Gene Symbol: CSDC2
  Gene Name: cold shock domain containing C2, RNA binding
  ENST ID: ENST00000460790
  CDS Start-End: 1-456
aagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgagcctaggccaaactcttcagaagtcacgacacacagatgtgggccccggtcacgcctcatgagctgtctctgggaagaaaatctcccggcatcgctgcaccgtgtcctgaggagacaccacgctgtggccaacagtccgggggtcggcaaagatctcaaagtcgttcccaccctgcacacagaggatgggcagaggagggatatttaggtggagtccctctccacattggctgctacggacctgcccctcctcctgccccttcagaactgccaggaagcccaccttctcaccccttgtcagacctgccctgacttgctgtgtgatgtagaacaagtgcccagcctcttggggccccagctttccaatctgtgtaacggggctggtgagcaatggttgttctccaggagccccctaagaggtctgttgtgttgccccatgttctggccttgacctcaggtgatttgcattggag

SEQ ID NO: 121387 - DNA, 3228 bp, Homo sapiens
  Payload ID: 3795
  Gene Symbol: CSDE1
  Gene Name: cold shock domain containing E1, RNA-binding
  Uniprot ID: O75534
  ENST ID: ENST00000261443
  CDS Start-End: 51-2354
gggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctg

SEQ ID NO: 121388 - DNA, 4006 bp, Homo sapiens
  Payload ID: 3795
  Gene Symbol: CSDE1
  Gene Name: cold shock domain containing E1, RNA-binding
  Uniprot ID: O75534
  ENST ID: ENST00000339438
  CDS Start-End: 447-2750
ctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagca

SEQ ID NO: 121389 - DNA, 4076 bp, Homo sapiens
  Payload ID: 3795
  Gene Symbol: CSDE1
  Gene Name: cold shock domain containing E1, RNA-binding
  Uniprot ID: O75534
  ENST ID: ENST00000358528
  CDS Start-End: 428-2824
gcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacact

SEQ ID NO: 121390 - DNA, 3774 bp, Homo sapiens
  Payload ID: 3795
  Gene Symbol: CSDE1
  Gene Name: cold shock domain containing E1, RNA-binding
  Uniprot ID: O75534
  ENST ID: ENST00000369530
  CDS Start-End: 476-2917
gagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaa

SEQ ID NO: 121391 - DNA, 4167 bp, Homo sapiens
  Payload ID: 3795
  Gene Symbol: CSDE1
  Gene Name: cold shock domain containing E1, RNA-binding
  Uniprot ID: O75534
  ENST ID: ENST00000438362
  CDS Start-End: 380-2914
cagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacacta

SEQ ID NO: 121392 - DNA, 3459 bp, Homo sapiens
  Payload ID: 3795
  Gene Symbol: CSDE1
  Gene Name: cold shock domain containing E1, RNA-binding
  ENST ID: ENST00000530886
  CDS Start-End: 589-2595
gcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaa

SEQ ID NO: 121393 - DNA, 626 bp, Homo sapiens
  Payload ID: 3795
  Gene Symbol: CSDE1
  Gene Name: cold shock domain containing E1, RNA-binding
  ENST ID: ENST00000525878
  CDS Start-End: 489-626
attggatgaatcatctctttgctcttatttcaaccttttaattactgatccaccctctttgattacctgacacaacaggaatatctttcgtaacttgaaagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaa

SEQ ID NO: 121394 - DNA, 521 bp, Homo sapiens
  Payload ID: 3795
  Gene Symbol: CSDE1
  Gene Name: cold shock domain containing E1, RNA-binding
  ENST ID: ENST00000525132
  CDS Start-End: 412-521
gtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccgtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaaca

SEQ ID NO: 121395 - DNA, 503 bp, Homo sapiens
  Payload ID: 3795
  Gene Symbol: CSDE1
  Gene Name: cold shock domain containing E1, RNA-binding
  ENST ID: ENST00000525970
  CDS Start-End: 483-503
attcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatatgtatatattctttttctttttaaaacagatgagctttgatccaaacctt

SEQ ID NO: 121396 - DNA, 2667 bp, Homo sapiens
  Payload ID: 3795
  Gene Symbol: CSDE1
  Gene Name: cold shock domain containing E1, RNA-binding
  Uniprot ID: O75534
  ENST ID: ENST00000534699
  CDS Start-End: 59-2455
tacgtaccgggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctg

SEQ ID NO: 121397 - DNA, 601 bp, Homo sapiens
  Payload ID: 3795
  Gene Symbol: CSDE1
  Gene Name: cold shock domain containing E1, RNA-binding
  ENST ID: ENST00000534389
  CDS Start-End: 318-601
agatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcct

SEQ ID NO: 121398 - DNA, 571 bp, Homo sapiens
  Payload ID: 3795
  Gene Symbol: CSDE1
  Gene Name: cold shock domain containing E1, RNA-binding
  ENST ID: ENST00000529046
  CDS Start-End: 162-571
attcctacgtaccgggccgtgctgcttatggcggcgctggagagggggcgctgagctgttgggatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgt

SEQ ID NO: 121399 - DNA, 4312 bp, Homo sapiens
  Payload ID: 3795
  Gene Symbol: CSDE1
  Gene Name: cold shock domain containing E1, RNA-binding
  Uniprot ID: O75534
  ENST ID: ENST00000610726
  CDS Start-End: 523-3057
tcactccgccccttctcgtgcacgcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagc

SEQ ID NO: 121400 - DNA, 526 bp, Homo sapiens
  Payload ID: 3796
  Gene Symbol: CLPS
  Gene Name: colipase, pancreatic
  Uniprot ID: P04118
  ENST ID: ENST00000259938
  CDS Start-End: 24-362
ccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttt

SEQ ID NO: 121401 - DNA, 461 bp, Homo sapiens
  Payload ID: 3796
  Gene Symbol: CLPS
  Gene Name: colipase, pancreatic
  ENST ID: ENST00000622413
  CDS Start-End: 1-297
atgattctcctgcctcagcctcccaagaagctgggattacaggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttt

SEQ ID NO: 121402 - DNA, 436 bp, Homo sapiens
  Payload ID: 3796
  Gene Symbol: CLPS
  Gene Name: colipase, pancreatic
  ENST ID: ENST00000616014
  CDS Start-End: 57-272
cccatcaccacagctggctctgtctcccgccacccacaccagctgtcccactcaccatggagaagatcctgatcctcctgcttgtcgccctctctgtggcctatgcagctcctggcccccgggggatcattatcaacctgacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttt

SEQ ID NO: 121403 - DNA, 602 bp, Homo sapiens
  Payload ID: 3797
  Gene Symbol: CLPSL1
  Gene Name: colipase-like 1
  Uniprot ID: A2RUU4
  ENST ID: ENST00000373861
  CDS Start-End: 95-460
ttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtt

SEQ ID NO: 121404 - DNA, 269 bp, Homo sapiens
  Payload ID: 3797
  Gene Symbol: CLPSL1
  Gene Name: colipase-like 1
  ENST ID: ENST00000428710
  CDS Start-End: 1-129
ggctgctgccaacgtgctccagacaattgcgagtcgcactgcgcggagaaggggtccgagggcagtctgtgtcaaacgcagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataa

SEQ ID NO: 121405 - DNA, 488 bp, Homo sapiens
  Payload ID: 3798
  Gene Symbol: CLPSL2
  Gene Name: colipase-like 2
  Uniprot ID: Q6UWE3
  ENST ID: ENST00000360454
  CDS Start-End: 5-466
gcccatggccgcagccctggcgctcgtggcgggggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagtggttggaactcttcaagggcagggatcgcatcatattcatctatgaagcacctacccccagcttagtatctgcacataaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 121406 - DNA, 405 bp, Homo sapiens
  Payload ID: 3798
  Gene Symbol: CLPSL2
  Gene Name: colipase-like 2
  Uniprot ID: Q6UWE3
  ENST ID: ENST00000403376
  CDS Start-End: 1-303
atggccgcagccctggcgctcgtggcgggggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 121407 - DNA, 5979 bp, Homo sapiens
  Payload ID: 3799
  Gene Symbol: CCBE1
  Gene Name: collagen and calcium binding EGF domains 1
  ENST ID: ENST00000398179
  CDS Start-End: 1-1011
aggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaaaaaaaaaaaaaaaaaaaaaaaaaggccgggcttggtggctcatgcctgtaatcccagcactttgggaggccgaggcgggcggatcacgaggtcaggagatcgagaccacagtgaaaccctgtctctactaaaaacacaaaaaattagtcgggcgtggtggtgggcgcctgtggtcccagctgctcgggaggctgaggcaggagaatggcgtgaacctgggaggcggagcttgcgctgagccgagatcgtgccactgcactccagcctgggcgacagagcgagactctgtctcaaaaaaaaaaaaatatcccttttgttgtgtttgaatgccacctttcagtcttcttccttaagaatgttaggaaggggctttgcaaacctctagtggcaacagtcttccttcccttcttcctaccacgttggaaatgcaggactcatgtcagtcagcatgtgaccgagtctttcatgaacactttgctcctctatgtctcatttatgcaaaattcctggtgactctccactaacatttttaaagtgaaagcaaactttcactttaaaaaaagtgagcgagaggatcccttgagcccaggagttcaaggccagtctgggcaacatagcaagaccccatccctaaaaaaaaaaaaataagttttattaaatgtggcactttcccctagaagggcagtaaccccaggaaccagtctgcctcttttcgaataaaggagactttttaaaaagaaaaaatttctttttagggtggggtgctctttatctagcatctttccttcctccttctctctgcaaaattcaacattcatgacagagggccacaccaaccacgggtttatagagagaggaactgaacagctgttgattcccatctggaatatatttaatgtttgcctgcttgtggagcatggtatttaaagggtgtggatggatgaatgtttaaaaaaaaacacacaaaactatgcacaagctgtatgagagatggctaggtccatctatgattttttttaaaagaagaattttaataccttttctttgacagtgaactgtatttagaaatatgatctttattgtgaaatgctcataaaatgcaaccaaactgcatgtttggccataggctagaataatatattaaaagaattaatggaaagtagtattgtctgggtttcatgaaactattccagataatattctccagcaaaacttatggtaacctgtattttataatgtcaatctgctggaccaagttaatttagaaaataatttttaatcctcagattttcaaaacttggactactgcaagactgatatgtactttttatgcccaaatcatatttttcaaagataggacatcataaggcatcattatttctaatgtatcttttaactagatagaaaaagctttactgtctaaacaggacttctgctcaaaacctaatgggaaagctatttctggggtaagatttgtaacagtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactctctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttactccccaggggatcaaagcaagtccccttaggaatttcatgtgtgccgtgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgcttaataacaaagttatttttctt

SEQ ID NO: 121408 - DNA, 6227 bp, Homo sapiens
  Payload ID: 3799
  Gene Symbol: CCBE1
  Gene Name: collagen and calcium binding EGF domains 1
  Uniprot ID: Q6UXH8
  ENST ID: ENST00000439986
  CDS Start-End: 39-1259
cggagctcggcgctgggaagaagccgggagcttccctgatggtgccgccgcctccgagccggggaggagctgccaggggccagctgggcaggagcctgggtccgctgctgctgctcctggcgttgggacacacgtggacctacagagaggagccggaggacggcgacagagaaatctgctcagagagcaaaatcgcgacgactaaatacccgtgtctgaagtcttcaggcgagctcaccacatgctacaggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtttcatgccatgcttatctgtaagtatcctatttagggaagaagattaaactctcttttcaaaaaaacaaagtgaaatgcctggattcacattaaaacaatgggctctcgtttgctataatattttaaagctgtttaatcaacagtggagtctgctctataaatatagattatttgttcaataaactggctgagcttagagagaggtgcagaattcctggttctgagcaggtgcccagaaggtaccattaggtgccatgatccaggctgaaccaatatacagtggggctgaagtctgcaaggaggttgctggcttgggctgacctcactaatgccatcagcagcggtaggtaaattttttctccttgggtattacaagtttttgtctggagccaaccaagcttgccaccaacatattgagagtaatacactattgaaagttatcttggatggggagaaaaaaaaatagtggttttccttgtttgcaaaaacttccttcctattctcattttttcttaattttctttaatttagtccaagttccagttcttttaggccttctctttgatttattttcccctgcatgtgagaagcagttcagaaaaaggtctatatctccacctcctagtgagttagagtgttttctcagagcacctctgggtggcaaagggaagcatgttcctgccaaggtttgctgtggattcagaagcaccaggagcaagagaccagaaggatgatctgctcctttgtaacgttgttgagggccctcttgtttccaatgagcagcttataggttactcacagtccactttctcactggacacacaaagtggctctttatctacctttgcgggagattttcactctcctgcaaatgatcgttctcacactcatattagctcatgttggaatttcccatcctgccatgtcctttcccatttctttttggcttttttgcctccaccttttagcccacatcatttaactccactactgtgaaagcttgcttaaagaaaatccctcttggccgggtgtggtagcccacgcctctaatcccagcactttgggaggctgaggcggggagatcacaaggtcaggagatcgagaccagcctgaccaacatggtgaaaccctgtctctactaaaaatacaaaaattagctgggcgtgttggcacacacctgtaatcccagctactcaggaggctgaggcaggagaattactttaacctgcggggggagcctagattgcgctactgcactccagcctaggcaacagagggagactctgtctcattaaaaaaaaaaaaaaaaaaaaaaaaaggccgggcttggtggctcatgcctgtaatcccagcactttgggaggccgaggcgggcggatcacgaggtcaggagatcgagaccacagtgaaaccctgtctctactaaaaacacaaaaaattagtcgggcgtggtggtgggcgcctgtggtcccagctgctcgggaggctgaggcaggagaatggcgtgaacctgggaggcggagcttgcgctgagccgagatcgtgccactgcactccagcctgggcgacagagcgagactctgtctcaaaaaaaaaaaaatatcccttttgttgtgtttgaatgccacctttcagtcttcttccttaagaatgttaggaaggggctttgcaaacctctagtggcaacagtcttccttcccttcttcctaccacgttggaaatgcaggactcatgtcagtcagcatgtgaccgagtctttcatgaacactttgctcctctatgtctcatttatgcaaaattcctggtgactctccactaacatttttaaagtgaaagcaaactttcactttaaaaaaagtgagcgagaggatcccttgagcccaggagttcaaggccagtctgggcaacatagcaagaccccatccctaaaaaaaaaaaaataagttttattaaatgtggcactttcccctagaagggcagtaaccccaggaaccagtctgcctcttttcgaataaaggagactttttaaaaagaaaaaatttctttttagggtggggtgctctttatctagcatctttccttcctccttctctctgcaaaattcaacattcatgacagagggccacaccaaccacgggtttatagagagaggaactgaacagctgttgattcccatctggaatatatttaatgtttgcctgcttgtggagcatggtatttaaagggtgtggatggatgaatgtttaaaaaaaaacacacaaaactatgcacaagctgtatgagagatggctaggtccatctatgattttttttaaaagaagaattttaataccttttctttgacagtgaactgtatttagaaatatgatctttattgtgaaatgctcataaaatgcaaccaaactgcatgtttggccataggctagaataatatattaaaagaattaatggaaagtagtattgtctgggtttcatgaaactattccagataatattctccagcaaaacttatggtaacctgtattttataatgtcaatctgctggaccaagttaatttagaaaataatttttaatcctcagattttcaaaacttggactactgcaagactgatatgtactttttatgcccaaatcatatttttcaaagataggacatcataaggcatcattatttctaatgtatcttttaactagatagaaaaagctttactgtctaaacaggacttctgctcaaaacctaatgggaaagctatttctggggtaagatttgtaacagtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactctctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttactccccaggggatcaaagcaagtccccttaggaatttcatgtgtgccgtgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgcttaataacaaagttatttttctt

SEQ ID NO: 121409 - DNA, 587 bp, Homo sapiens
  Payload ID: 3799
  Gene Symbol: CCBE1
  Gene Name: collagen and calcium binding EGF domains 1
  ENST ID: ENST00000589419
  CDS Start-End: 449-587
ctttgcctgctgccatctatgtaagacgtgacttgttcctcctcgccttttgccgtgattatgaagcctccccagccatgtggaactgaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaagg

SEQ ID NO: 121410 - DNA, 3704 bp, Homo sapiens
  Payload ID: 3800
  Gene Symbol: COLGALT1
  Gene Name: collagen beta(1-O)galactosyltransferase 1
  Uniprot ID: Q8NBJ5
  ENST ID: ENST00000252599
  CDS Start-End: 121-1989
ttcacgcccggcgcgctcctcccctttaaggcgcgcggccgggcggggcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcaca

SEQ ID NO: 121411 - DNA, 654 bp, Homo sapiens
  Payload ID: 3800
  Gene Symbol: COLGALT1
  Gene Name: collagen beta(1-O)galactosyltransferase 1
  ENST ID: ENST00000597147
  CDS Start-End: 1-654
gaaggcggcgtccaggaacctggccttctacccacctcaccctgactacacctggtcctttgacgacatcatcgtctttgccttctcctgcaagcaggcagtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgat

SEQ ID NO: 121412 - DNA, 552 bp, Homo sapiens
  Payload ID: 3800
  Gene Symbol: COLGALT1
  Gene Name: collagen beta(1-O)galactosyltransferase 1
  ENST ID: ENST00000600474
  CDS Start-End: 139-552
agagctctgaagaaacctttgactggtgacttctcactccctgcctcagttttctcaaatggaaaatgggtccgggtgcagtggctcacgcagtaatcctagcaatttgggaggccaagggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagtt

SEQ ID NO: 121413 - DNA, 5177 bp, Homo sapiens
  Payload ID: 3801
  Gene Symbol: COLGALT2
  Gene Name: collagen beta(1-O)galactosyltransferase 2
  Uniprot ID: Q8IYK4
  ENST ID: ENST00000361927
  CDS Start-End: 373-2253
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcaggcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 121414 - DNA, 2325 bp, Homo sapiens
  Payload ID: 3801
  Gene Symbol: COLGALT2
  Gene Name: collagen beta(1-O)galactosyltransferase 2
  ENST ID: ENST00000367520
  CDS Start-End: 438-1529
ttttcgtttttttgttctatgtatgcctagatttagctttaataatctgtcagcgttacagaattttcctgtttgctttcatatcaaatgtggatttcattcctcattttcttgttatttcctgtaggtggattacagtgttccattctgctctccagaatgggaattccttgcctcccttttgatcctttcatgccttttttgttcattccaggccatgagtttgctttttcttcagagggaaaaaatcaatttcctctgggctgaagaatagccgagtgtttttattagtccccaatgctgtgttttacttttttaataaaggagcattttttaggtctatagacatacctgaaacaaccacttatttaattgcagtgtcaaactcagcatcagacacagttcaggttccttctcctcgcttgtcactcagcagtatgttttctgattgttggctttgtccctctcttggatcctcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatat

SEQ ID NO: 121415 - DNA, 4723 bp, Homo sapiens
  Payload ID: 3801
  Gene Symbol: COLGALT2
  Gene Name: collagen beta(1-O)galactosyltransferase 2
  ENST ID: ENST00000367521
  CDS Start-End: 1095-1799
ttttctattcttttactttcaacctatttttgtcttttaatctaaaggctgcctcttatagataccacatggttgtattaatttttaaaacttactatgccaaattcttccttcattgcagtgttttattcatttgccttcactacatttttttccagatccttaaggtcagccagaggtgagagactagggacttctcaagtttttcctgggcgtgtggacagccctgaatatgcctggggccttctagattctcagggatattttggagcaaatcaaactccctatggacctcttattccttggtttttccttttaagttttttggtgggcttcttgttagcatcagctgataatgcttctcaaacagctgtaatgttaaacagttgttgctcatgggttttgacaaatgacctgcagatagtgctgttcacagaaaatgaactctgagtcaggtcaaatcaagacaagctctgagaatgtagcttttcaaggagctactagacaggttgaatagagattattttctgggggcaggtctttaagggagtctcagtccattttgtccctgccagtggcttctgggttggtggggtttgccgctctcttagttgtgaggctactggttttcaaggcttttgtagggctggggtgaacaggttaggattagggcagctgtgaacttcacaaagctcactgtgttaacagagattcagcagtaggtcttgatcaaacactccttggattattgcagtactttaactaatttccataggagtgtacttattaaatcttgtcaaaaaactgatgatgcttagaactatgttgggcactatgagggatacacaaaaatatgataccctcttgtcttcccagacctcataatactagtgtgacacattagcctggaggaacttctaaggaataaagggaagcctctctgtctttgtctgtgtgggggaggggtgtttgcagaactaactctctctttctctggcctttgtggtggggacctttgacttgttaatctccagacgtgttttatgtgatgcagggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 121416 - DNA, 1271 bp, Homo sapiens
  Payload ID: 3802
  Gene Symbol: CTHRC1
  Gene Name: collagen triple helix repeat containing 1
  Uniprot ID: Q96CG8
  ENST ID: ENST00000330295
  CDS Start-End: 143-874
gggagggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaccttaata

SEQ ID NO: 121417 - DNA, 571 bp, Homo sapiens
  Payload ID: 3802
  Gene Symbol: CTHRC1
  Gene Name: collagen triple helix repeat containing 1
  ENST ID: ENST00000415886
  CDS Start-End: 108-551
gatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggtaagtttgaattattttaaaattgaagcaagatttaagggttttcatattttagtgttaatttttaggtgacattttatttttttttaact

SEQ ID NO: 121418 - DNA, 560 bp, Homo sapiens
  Payload ID: 3802
  Gene Symbol: CTHRC1
  Gene Name: collagen triple helix repeat containing 1
  ENST ID: ENST00000520880
  CDS Start-End: 205-546
tttgcatagaccaatgagaaaataagcaaacaagaaacctgggccttatcattgcatcatatagataaagactaaaaaccctgcctatcctttactccctcatactgtttgctgttgctcgaaaagaaacacgtcaagagtcaatacgaatggacagaactagtctagaatgtaagttccatgaaggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttc

SEQ ID NO: 121419 - DNA, 1198 bp, Homo sapiens
  Payload ID: 3802
  Gene Symbol: CTHRC1
  Gene Name: collagen triple helix repeat containing 1
  Uniprot ID: Q96CG8
  ENST ID: ENST00000520337
  CDS Start-End: 120-809
agaaggtttaaggccggaaagggaaatgaaggggcccggcgctaaccctctaaggacctgttttgcttctgtttaaaccaaatgggcagtctgtcattacacacaccctgggtcttcatatgtggccgccaggtaggagcatcacagtcaagctacgggagaaaacagtttccaggaaactggaaatgaacggcccgagtgctttccaggggctcatctgtgggaagtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaa

SEQ ID NO: 121420 - DNA, 6727 bp, Homo sapiens
  Payload ID: 3803
  Gene Symbol: COL1A1
  Gene Name: collagen, type I, alpha 1
  Uniprot ID: P02452
  ENST ID: ENST00000225964
  CDS Start-End: 120-4514
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 121421 - DNA, 549 bp, Homo sapiens
  Payload ID: 3803
  Gene Symbol: COL1A1
  Gene Name: collagen, type I, alpha 1
  ENST ID: ENST00000507689
  CDS Start-End: 88-549
gcggactaaagctttgtttaaattcctgagaactggaaagagttacagcctccctggccaggcgcctcggcgctgtcacccgcgctgatgaggagcaggcgagcttttaaggatttgaggaaagaagaacggggggaggggcgggaagtgaaaaatccaagtgtgcctcttagacccgggggaaaggtggttaagctgggggttgcagtcactactgacaacgcccctcttccgcctgtcccagtcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctgga

SEQ ID NO: 121422 - DNA, 5411 bp, Homo sapiens
  Payload ID: 3804
  Gene Symbol: COL1A2
  Gene Name: collagen, type I, alpha 2
  Uniprot ID: P08123
  ENST ID: ENST00000297268
  CDS Start-End: 472-4572
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 121423 - DNA, 4523 bp, Homo sapiens
  Payload ID: 3804
  Gene Symbol: COL1A2
  Gene Name: collagen, type I, alpha 2
  ENST ID: ENST00000620463
  CDS Start-End: 119-4213
gtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatttttcgaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgc

SEQ ID NO: 121424 - DNA, 4257 bp, Homo sapiens
  Payload ID: 3805
  Gene Symbol: COL2A1
  Gene Name: collagen, type II, alpha 1
  Uniprot ID: P02458
  ENST ID: ENST00000337299
  CDS Start-End: 1-4257
atgattcgcctcggggctccccagacgctggtgctgctgacgctgctcgtcgccgctgtccttcggtgtcagggccaggatgtccggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcagggcctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggccctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggcaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaa

SEQ ID NO: 121425 - DNA, 5071 bp, Homo sapiens
  Payload ID: 3805
  Gene Symbol: COL2A1
  Gene Name: collagen, type II, alpha 1
  Uniprot ID: P02458
  ENST ID: ENST00000380518
  CDS Start-End: 166-4629
gggagaagacgcagagcgctgctgggctgccgggtctcccgcttccccctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagacgctggtgctgctgacgctgctcgtcgccgctgtccttcggtgtcagggccaggatgtccaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtgggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcagggcctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggccctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggcaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaca

SEQ ID NO: 121426 - DNA, 5543 bp, Homo sapiens
  Payload ID: 3806
  Gene Symbol: COL3A1
  Gene Name: collagen, type III, alpha 1
  Uniprot ID: P02461
  ENST ID: ENST00000304636
  CDS Start-End: 171-4571
gtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 121427 - DNA, 3873 bp, Homo sapiens
  Payload ID: 3806
  Gene Symbol: COL3A1
  Gene Name: collagen, type III, alpha 1
  Uniprot ID: P02461
  ENST ID: ENST00000317840
  CDS Start-End: 105-3596
gacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatg

SEQ ID NO: 121428 - DNA, 268 bp, Homo sapiens
  Payload ID: 3806
  Gene Symbol: COL3A1
  Gene Name: collagen, type III, alpha 1
  ENST ID: ENST00000450867
  CDS Start-End: 1-268
aagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggccctcctgggattaatggtagtcctggtggtaaaggcgaaatgggtcccgctggcattcctggagctcctggactgatgggagcccggggtcctccaggaccagccggtgctaatggt

SEQ ID NO: 121429 - DNA, 6532 bp, Homo sapiens
  Payload ID: 3807
  Gene Symbol: COL4A1
  Gene Name: collagen, type IV, alpha 1
  Uniprot ID: P02462
  ENST ID: ENST00000375820
  CDS Start-End: 123-5132
gcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctta

SEQ ID NO: 121430 - DNA, 2547 bp, Homo sapiens
  Payload ID: 3807
  Gene Symbol: COL4A1
  Gene Name: collagen, type IV, alpha 1
  ENST ID: ENST00000543140
  CDS Start-End: 105-1664
cgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccattgctttttcaaatccataaatgaaatatccggatcacattgacatgaaacctttcaatggaacaaaataccagcttcttagcttttgtagtttgttttaaaagaatccactaaatagaagagcataataataatcttgaattttgaaggacattattttcttgcatataatgacttctgtttctgaagttttgaaatctcaaggcattgttcctctcgtattttctttgttcttctgagctttgcgagcatggactggtttccacaattcctttcattcctttttttctttttgtaagatattgaaagtcaaatttcagaattattcatttctgatgtagcccttcaaattttttaatttttaaagatattgctggaagcttctacaaaagaaaaccagggcaaaagcgagttgaaatagcaatgacccagctggaattcagcaatcattttctgcttttgaagttagatcttgggcttttgctctccagaacttccctggtgcctggggagctgagttagaagttgcaattgtttaagatatatctaaataaattagaagttcaaataactgggtagccctgactgtagtggggatcaaagacagaagaactttgaaggaagcagaaaaggacgtttttaacctctatgcaccgcttcatctcctgggctttcctggtggacttcctgcctcaactctggctgaaactcagtctagacatatctaataaaagacggaaaaagaggaaagaggtgagaaagaaggaatattgaggaaagatcataatatagaagaaaagaaagaaaacatacaaccccaattctactccttatgccttcatcaggagctcctttctttccggagttggaaaaagtctctaaaaataaatttatgggtaaataattc

SEQ ID NO: 121431 - DNA, 1077 bp, Homo sapiens
  Payload ID: 3807
  Gene Symbol: COL4A1
  Gene Name: collagen, type IV, alpha 1
  ENST ID: ENST00000615732
  CDS Start-End: 408-1077
tctcccctcttcgggagcctggcgtgggtgtctcagaactgatctgctttcagtctgagttttgccatcctctgcggcgagcctgcgagcttgcacacttgggcaggatgcgctcagcgccctagctcagaggccgacccagggcagagccagtcagcgggcgctgggacgcaggactctgaacatgggtcctctgcctccctcccacctcctccaggcccggccactcggcttcctggtgaggaattcttaacgaccgccaaatccggtttctagagataaaagacggttgaagggtggctgtgctggctctggctgtggcaaatgtgactgccatggagtgaagggacaaaaggtgaggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagagtaa

SEQ ID NO: 121432 - DNA, 6281 bp, Homo sapiens
  Payload ID: 3808
  Gene Symbol: COL4A2
  Gene Name: collagen, type IV, alpha 2
  Uniprot ID: P08572
  ENST ID: ENST00000360467
  CDS Start-End: 307-5445
gggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttccctggtatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccactggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtttccgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 121433 - DNA, 491 bp, Homo sapiens
  Payload ID: 3808
  Gene Symbol: COL4A2
  Gene Name: collagen, type IV, alpha 2
  ENST ID: ENST00000400163
  CDS Start-End: 177-491
agttaacaatttctatacagttaagtggatttagtgagtatcattcttccaggagagaagtaaaatttttttttaaagaggaaaacaaagaacaagattaagaacagtaaaagaataagtatggaaaatctggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtg

SEQ ID NO: 121434 - DNA, 868 bp, Homo sapiens
  Payload ID: 3808
  Gene Symbol: COL4A2
  Gene Name: collagen, type IV, alpha 2
  ENST ID: ENST00000617564
  CDS Start-End: 1-128
gaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtgggagcaaggtgctgagccataccacactgtggatgaacctggaacatgttatgccatggggattgagacccacacagaaggacacatgctatcacatggtctctcattctattcttatgaaatgtccacacaggcaacctagaaacaggaagtcgattggtggctgccacaggtggaggtgggggtgggggtggggagtacctgcttaatgggaatggggtttctttttgatataatgaagatgttctgaaattagataagagtgatggttgcacaaccttgtgaaaatactaaaaatcactgaattttatgctttaaaacagtgaactttgtgctatatgaattatatctcaaaaaaaccta

SEQ ID NO: 121435 - DNA, 910 bp, Homo sapiens
  Payload ID: 3809
  Gene Symbol: COL4A3
  Gene Name: collagen, type IV, alpha 3 (Goodpasture antigen)
  ENST ID: ENST00000304990
  CDS Start-End: 1-471
ggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctgtttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaa

SEQ ID NO: 121436 - DNA, 8097 bp, Homo sapiens
  Payload ID: 3809
  Gene Symbol: COL4A3
  Gene Name: collagen, type IV, alpha 3 (Goodpasture antigen)
  Uniprot ID: Q01955
  ENST ID: ENST00000396578
  CDS Start-End: 163-5175
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggtgctgctggtttgaaaggacaaaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgga

SEQ ID NO: 121437 - DNA, 2262 bp, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENST ID: ENST00000261415
  CDS Start-End: 423-2219
aaatagtgggccaggcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttg

SEQ ID NO: 121438 - DNA, 886 bp, Homo sapiens
  Payload ID: 3810
  Gene Symbol: COL4A3BP
  Gene Name: collagen, type IV, alpha 3 (Goodpasture antigen) binding protein
  ENST ID: ENST00000357457
  CDS Start-End: 1-704
atagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagctcagaggatgaaacaggaaactgagtcataaaacactactacaaacaagcccaaggattttatcccagattttcaacccaaggatgagctgcaatataactatcactgttttgttggctgcctgccacagaatgaccactgaggaaataaagcgagctttggattcactgca

SEQ ID NO: 121439 - DNA, 5651 bp, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENST ID: ENST00000380494
  CDS Start-End: 295-2553
agatgctcccgggctttcgacaagccgccctggaaagcaggcccgtcatcttcagcggaaagctctctcacgtctgggcccgcaagcccggagggttcgtcataaacacacaaggcaaggatagaagcgaggccgaggggctggtcacgcaactgtcaaacgaagcccacccaccgactgacaaggccccaaggggacaagcgatccccgcgcgggatactcacccgttacctcaggatcgcgactacaactcccaggaggctgcgcgagcgacggaccaacgcccttcccagaatgcagcacagctgcatccctaccccgccctctcctttctccgctcctcctgcttttctacccgtcgtcacccgggagagccggagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaata

SEQ ID NO: 121440 - DNA, 2843 bp, Homo sapiens
  Payload ID: 3810
  Gene Symbol: COL4A3BP
  Gene Name: collagen, type IV, alpha 3 (Goodpasture antigen) binding protein
  Uniprot ID: Q9Y5P4
  ENST ID: ENST00000405807
  CDS Start-End: 423-2297
aaatagtgggccaggcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttccttcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattca

SEQ ID NO: 121441 - DNA, 693 bp, Homo sapiens
  Payload ID: 3810
  Gene Symbol: COL4A3BP
  Gene Name: collagen, type IV, alpha 3 (Goodpasture antigen) binding protein
  ENST ID: ENST00000508809
  CDS Start-End: 1-379
gcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgttttttgatgttcccctatagagtattgtttcgttggtttttgttgttgtcgttgttgttgttttaaacagggtcttgctctgtttcctaagctgaagtgcaatgacaccatcacggctcactgcaacctcaacctctggcctcaaacaatcctctcatctcagccttcccagtagctgggagtccccacaggcatgtgccaccatgctcagct

SEQ ID NO: 121442 - DNA, 9895 bp, Homo sapiens
  Payload ID: 3811
  Gene Symbol: COL4A4
  Gene Name: collagen, type IV, alpha 4
  Uniprot ID: P53420
  ENST ID: ENST00000396625
  CDS Start-End: 209-5281
cgagagcgccgcgaagaggcagcggggcgcgggtggattggggctggaggtgcgcgtcccgtggggtggcaaggcggcagctcctggcgctgcgggcgtccccacaggaacagactttgacccagaacacagaacctcacttgtcaacaagaaccttctggaagagaagactggcagaatattttttaagtactaagacttgcctgcgatgtggtctctgcacatagtactaatgaggtgctccttcagattgaccaagtccttggccacaggtccctggtcacttatactcattctcttttctgtacaatatgtatatgggagtggaaagaaatacattggtccttgtggaggaagagattgctctgtttgccactgtgttcctgaaaaggggtctcggggtccaccaggaccaccagggccacagggtccaattggacccctgggagccccaggacccattgggctttcaggagagaaaggaatgagaggggaccgcggccctcctggagcagcaggggacaaaggagataagggtccaactggtgttcctggatttccaggtttagatggcatacctgggcacccagggcctcctggacccagaggcaaacctggtatgagtggccacaatggctcaagaggtgacccagggtttccaggaggaagaggagctcttggcccaggaggccccctaggccatcctggggaaaagggagaaaaaggaaattcagtgttcattttaggtgccgttaaaggtattcagggagacagaggggacccaggactgcctggcttaccaggatcttggggtgcaggaggaccggcaggtcccacaggatatcctggagagccagggttagtgggacctccgggccaaccagggcgtccaggtttgaagggaaatcccggtgtgggagtaaaggggcaaatgggagacccgggtgaggttggtcagcaaggttctcctggacccaccctgttggtagagccacctgacttttgtctctataaaggagaaaagggtataaaaggaattcctggaatggttggactgccaggaccaccaggacgcaagggagaatctggtattggggcaaaaggagaaaaaggtattcctggatttccagggcctcggggggatcctggttcctatggatctccaggttttccaggattaaagggagaactaggactggttggagatcctgggctatttggattaattggcccaaagggggatcctggaaatcgagggcacccaggaccaccaggtgttttggtgactccacctcttccactcaaaggcccaccaggggacccagggttccctggccgctatggagaaacaggggatgttggaccacctggtcccccaggtctcttgggcagaccaggggaagcctgtgcaggcatgataggaccccctgggccacaaggatttcctggtcttcctgggcttccaggagaagctggtattcctgggagacctgattctgctccaggaaaaccagggaagccaggatcacctggcttgcctggagcaccaggcctgcagggcctcccaggatcaagtgtgatatactgtagtgttgggaaccccggaccacaaggaataaaaggcaaagttggtcccccaggaggaagaggcccaaaaggagaaaaaggaaatgaaggactctgtgcctgtgagcctggacccatgggcccccctggccctccaggacttcctgggaggcaggggagtaagggagacttggggctccctggctggcttggaacaaaaggtgacccaggacctcctggtgctgaaggacctccagggctaccaggaaagcatggtgcctctggaccacctggcaacaaaggggcgaagggtgacatggttgtatcaagagttaaagggcacaaaggagaaagaggtcctgatgggcccccaggatttccagggcagccaggatcacatggtcgggatggacatgctggagaaaaaggggatccaggacctccaggggatcatgaagatgcgaccccaggtggtaaaggatttcctggacctctgggccccccaggcaaagcaggacctgtggggcccccaggactgggatttcctggtccaccaggagagcgaggccacccaggagttccaggccacccaggtgtgaggggccctgatggcttgaagggtcagaaaggtgacacaatttcttgcaacgtaacctaccctgggaggcatggccctccaggttttgatggacctccaggtccgaagggatttccaggtccccaaggtgcccctgggctgagtggttcagatgggcataaaggcagacctggcacaccaggaacagcggaaataccaggtccacctggttttcgtggtgacatgggagatccgggttttggaggtgaaaaggggtcctcccctgttgggcccccaggccctcccggctcaccaggagtgaatggtcagaaaggaatcccgggagaccctgcatttggtcacctgggacccccgggaaagaggggtctttcaggagtgccagggataaaaggacccagaggtgatccgggatgtccaggggctgaagggccagctggcattcctggattcctaggtctcaaaggtcccaaaggcagagagggacatgctgggtttccaggtgtcccaggtccacctggccattcctgtgaaagaggtgctccagggataccagggcaaccgggactccctgggtatccaggtagcccaggtgctccaggtgggaaaggacagccgggagatgtggggcctcccgggccagctggaatgaaaggcctccccggactcccaggacggcctggggcacatggtcccccaggcctcccaggaatcccaggtccctttggagatgatgggctacctggtcctccaggtccaaagggaccccgggggctgcctggtttcccaggttttcccggagaaagaggaaagcctggtgcagagggatgtcctggcgcaaagggagaacctggagagaagggcatgtctggccttcctggagaccggggactgagaggggccaaaggagccataggacctcccggagatgaaggagaaatggctatcatttcacaaaagggaacacctggggaacctggacctcctggagatgatggattcccaggagaaagaggtgataaaggaactcccgggatgcaagggagaagaggagagccgggaagatacggaccacctggatttcacagaggggaacctggtgagaaaggtcagccagggcctcctggacccccaggccctccaggctcaactggtctaagagggttcattggttttccaggacttccaggtgaccagggtgagccaggttctccaggtccccctggattttcaggaattgatggagcaagaggacctaaaggaaacaaaggtgaccctgccagtcactttggtccacctggtccaaagggtgagccaggtagccctggatgtccagggcattttggagcatccggagagcagggcttgcctggtattcaagggcccagaggatcacctggaaggccagggccacctggctcctctggaccaccagggtgcccaggtgatcacgggatgcctgggctgaggggacagccaggagaaatgggagaccctgggccaagaggcctccagggggatccagggataccaggtcctccgggaataaaaggtccctccggatcacctggcctgaacggcttgcatggattgaaaggtcagaaaggaactaaaggtgcttcaggtttgcatgatgtggggccacctggtccagtgggaatacctgggctaaaaggggagagaggagaccctgggagcccaggaatctctcctccaggtcctcgtggaaagaaaggtcccccaggacccccagggagttcaggaccacctggtcctgcaggtgccacaggaagagctcctaaggacattcctgacccgggtccacctggagatcagggacctcctggtcctgatggcccaagaggagcacctgggcctccaggcctccctgggagtgttgaccttctgagaggggagccaggtgactgtggtctaccagggccaccaggtccccctggcccaccaggccctccaggatacaaaggctttccaggatgtgatggaaaagatggccagaaaggaccagtgggattcccgggaccgcagggaccacatggatttcctgggccacctggagagaagggtttacctggacctccagggagaaaagggcccactggtcttccgggtcccagaggtgaaccggggccacctgcagatgtggatgactgtccccgaatcccaggccttcctggggcgccaggcatgagaggaccagaaggagccatggggctccctggaatgagaggcccctcaggaccagggtgcaaaggagagcctgggctggatggcaggaggggtgtggatggcgtccctgggtctcctgggcctcccggacgtaaaggtgacacaggagaagacggctaccctggaggaccagggcctcctggtcccattggggatcctgggcccaaagggtttggccctggatacctcggtggcttcctcctggttctccacagtcagacggaccaggagcccacctgccccctgggcatgcccaggctctggactgggtatagtctgttatacctggaagggcaagagaaagctcacaatcaagaccttggtctggcagggtcttgccttcccgtatttagcacgctgccctttgcctactgcaacatccaccaggtgtgccactatgcccagagaaacgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatgcacacaggagctggggaccaaggaggagggcaggcccttatgtcacctggcagctgcctggaagatttcagagcagcaccattccttgaatgccagggccggcagggaacttgccactttttcgcaaataagtatagcttctggctcacaacggtgaaagcagacttgcagttttcctctgctccagcaccagacaccttaaaagaaagccaggcccaacgccagaaaatcagccggtgccaggtctgcgtgaagtatagctagagaatgcgaaattcaccaacacgtggccaagagaaacttcctagggggctaagacttcctagactgtgctaagagatgtcatggtgctcattttggactccctttcagtggttccttctgttttgtcgtggttattcccagagtcctctggttccttacacattaagcaaatgctgcacagatggatttgtttggacctcccaatctagggagcctagatactcttattttactgaggatgatcgaagaactggctttacttaaaaatatgctaattctcagaaaggcaagtagatgataaaggccagattacaaattacattactgaaaacttcattcttgggttaacagtatctcaaacaattgaagtcaattactctataatacagtgggcttctggatggattttataggaaaaaataaacaggtcaatgaatgaaactagaaagcagagattttcaacatttcaaaatgatttcctctgtaatctatttttccatatactttaaataatggtaaaaccatgacgcaaagagagatttttttttaaagaagaaaaaaaaaaattcacactgccagcgttaacagttcctttcaaaggagaatgaatcatgatggcaggaaggcccacagtcgccgtattccagagatgcgacattagcataaacacatcacagatgaatataaaacattatgttctcttctgcatttttcagagaatagaaatgcctactttggcaacccttttgaaaagtagcaattatggaaaaaaaatattcaataagagattaggagcctaaaagctattagtgaatattaaggtagttattcacaaaaattgactccccattgcagtgaacttccagacagactgcttttccccagtcggggtccggcgtgtcacaggtgcgtgcgtgctaatgggactgacgctacatggggctcactcaggcaggcacgcgcttcatacaaagcatctcactcccctccccaggagagcctgcacagcttcttgcactcacaacggacactttgctccacacacataatggcagctcacacagggacgtgacagagctatcattatgcacttgggagaaaattaagggccgatttaattaaacttaggtaagaagattcatttaagtcagggttaccccatcaggaggacatggcactatctttaaacgaaacaaagacaatttataatttgaattttatgctcccgtggttggctgttacaggagcatcccattttgccaattttaaagacattcttatatttcatatcagtcttgtaccaaggcaacagtttgacatttggcattagtattttctaaaaaagtttagaatgtgtgtcaatttataatgattatttttttctgtaaagcaaaagatccctttttctgttttgctaggaatttggtgatctaatcctaaatttaaaagatttgttggaaaaaatttttaggaaactcaccttcctcatctaaaagaaaaaggcattttagagaaaactaaagaaatttctcatgagcgtgacactcattttagtgctttgtttccgtgcacttaaaaataattgagaagaaaaactcaattaaaattttgtttataagaaatgttttccttgccaaaccttgatttgtaatgagctcttatatgcagaacacatttcaaatgagttttgctatgggctgcccccagggtggcaatttattttaagagtattttctggtaaaaagaaaaatgtgtattttaagatgaaatattttcttgatgtagcagaatatttcctagttcatttgacccatttgatattttttaaaccatgctctggcatgttgaatatttttgtgcacctaaaacttaagccaatttcaatcttatttgtgattacctttctccttcccaaaaagctttatctattaccaaaagtcaaccctcctaaaagttcaacctgttcatcttgaacttggcctgagaacattttctgggaagaggtaagggtgacaaatggaacatcagaaacgtatcttgcttgctaattattttaaacactttaatgttggtattagaatattatcttcataagttaataaataagtaaaaaaaaaaaacccacacaaagacaggctaaattatgtagacagtttactccacagtgagcttgggaaggtatcagactgttcaaaatgttagtattacaagagctgtctctaaatgcagcattaacactgccctctaattttacaaaagtattttaaaggatcaaaagggcggaaaaataacttcttggaatagaagatcctgttaccttaaaccattattttcttcacctggttatatatcaatgtgccttcaattaccctttctctgtggaggtgatgaacaaagcttttaagttgttctcctaacccattattggagatgatccttatcaaacccttctctccctgcctccccaccaaccttgtagactggaacgtgcctagattgccctaatgggaactgttctgttctgtgcccgtgctggaaatctgggatgcttccttctgggttctgattctcagtgagtggagcccattcatccaggcaggtttccatgctatgagtggccctttcgttctgctctcacactccccacattgaaagctgagtcatcgctgctttggatggctacctcctctttagccccgtgcccgtctcacacagcctttgttttccacctccacccttgcagtaggcatctcccagttggtgccttagtttcaaatcccagttgccatctaagatccacccaaacttgattttgtcaccctctggattagaatccttctgtgactccgctgcccatgaagtccaaatgacttcctatggggtgaaaggtccagtggggactgttcgagggttccctctaggagtatttcctgtcatgatgaactgtgtgcagctctgcagacactcccagcacctcttcgactttgctcctgcttcaccagtgatgtcctccctggggtcagtttaccctgcgtgggaggtgaattccctgggggaaacttaggctcccttctgctgctcttgtgcagtgcacggggctgtcctcattttctccgttccccattgcttctttaatgtctcagtgcacttccttcattccattgccaaaatgcaagccccttgagggcagggaccatgcttgactcgtttttgtatgcctaatgcctagcacagagttgaacacattactgccaattcatttttttcaatgacaattccataaacatcattaggcattaggtgttcagctctgcatataaggtcttcatcagcaagacggttacaagtataaaccatttcctatttcagaatattttaatattcaacatatttgtatacccacattctcttgttacaattattgccagaaagccaattgataagctttcaaaatgggcttatcacacccctccaaaaatagatttttgttttttctataaacagaaatttcagaaatgagatttgagagatccgactgagaagacccttcagtaaaatgtgacatgacttaccttatgctgtaatctgtattccctcaggatttaagagcttcctagcataaaatctttgctaaacgtttgtgtacatgttattggtgctccgaaaaatagtcaatggaatggtgcactacaattgggctttatcatcttattttgaacctcgtgtagattacagtaaagcaaaccattcagtgtgttccaggaaattatattagatctgtgtttctatcagctcactggaataatctgataattgttacttttacttggtatggctgcaagaatagtggaaagaagaggacttgagagttggtcgaacccaggtttgaaatctggcttagtcatttttcagctgttatcctgggtgagttttgccaactttcttagcttcatttccctcattaatacggtgggacataacagctactcttgcattgaaaattaagttagattacctgtctagcatacccatcatcatacacttactatggtcacattttgtatttaaaataaactaatacgaaaaatatttctttttttttacacagaattatgattctcacagggtatataaattactgattagaattatttatatgtggccaattcttaatgtcattgggaatgctgtttcatttcaatcctcaaagttactgtagcacagaaaatatcacaatttcctgcagggacattatcagtaagttctgcagggaacaaacaattgacattaaaaatcagtactctgcaattgtcactgttatcatctgctagaaactctgcataatgcattttaaaccaccaaggctggctgccacatccatgtgaaatgcttgaattttatggtgcttaaatatttaatgattcatgggaaaaatgtgaaatgtgtctaataaattgcatccctttctctaacctctggttgtaaagttaaagactttcagcatgtaacttttgcaagatgcctggtctgccattggcacttaaatatttgttgtattacgatttataatatggttcattatatataaaattctgtgatgacttccaaaaacaa

SEQ ID NO: 121443 - DNA, 6483 bp, Homo sapiens
  Payload ID: 3812
  Gene Symbol: COL4A5
  Gene Name: collagen, type IV, alpha 5
  Uniprot ID: P29400
  ENST ID: ENST00000328300
  CDS Start-End: 245-5320
agaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaa

SEQ ID NO: 121444 - DNA, 6469 bp, Homo sapiens
  Payload ID: 3812
  Gene Symbol: COL4A5
  Gene Name: collagen, type IV, alpha 5
  Uniprot ID: P29400
  ENST ID: ENST00000361603
  CDS Start-End: 245-5302
agaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 121445 - DNA, 790 bp, Homo sapiens
  Payload ID: 3812
  Gene Symbol: COL4A5
  Gene Name: collagen, type IV, alpha 5
  ENST ID: ENST00000515658
  CDS Start-End: 1-347
aaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattattttt

SEQ ID NO: 121446 - DNA, 537 bp, Homo sapiens
  Payload ID: 3812
  Gene Symbol: COL4A5
  Gene Name: collagen, type IV, alpha 5
  ENST ID: ENST00000505728
  CDS Start-End: 1-524
gtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagatgataagaagatatgttttagggtttgtggccagtccaaaataaaaagggaaaactt

SEQ ID NO: 121447 - DNA, 859 bp, Homo sapiens
  Payload ID: 3812
  Gene Symbol: COL4A5
  Gene Name: collagen, type IV, alpha 5
  ENST ID: ENST00000504541
  CDS Start-End: 1-222
tttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaacccta

SEQ ID NO: 121448 - DNA, 6700 bp, Homo sapiens
  Payload ID: 3813
  Gene Symbol: COL4A6
  Gene Name: collagen, type IV, alpha 6
  Uniprot ID: Q14031
  ENST ID: ENST00000334504
  CDS Start-End: 235-5307
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtga

SEQ ID NO: 121449 - DNA, 6570 bp, Homo sapiens
  Payload ID: 3813
  Gene Symbol: COL4A6
  Gene Name: collagen, type IV, alpha 6
  Uniprot ID: Q14031
  ENST ID: ENST00000372216
  CDS Start-End: 102-5177
tccctgggctgctggtcttctttaccttccagctgctcacagaacagagagtttctacatacaagcagaagatgtgaaaatattgggaataaataaagtatatgcttataaacaagttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtga

SEQ ID NO: 121450 - DNA, 6750 bp, Homo sapiens
  Payload ID: 3813
  Gene Symbol: COL4A6
  Gene Name: collagen, type IV, alpha 6
  ENST ID: ENST00000394872
  CDS Start-End: 235-5358
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgactgctgctgtagagaggttggtaaaggagacttagacacagagagaggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtg

SEQ ID NO: 121451 - DNA, 6380 bp, Homo sapiens
  Payload ID: 3813
  Gene Symbol: COL4A6
  Gene Name: collagen, type IV, alpha 6
  ENST ID: ENST00000545689
  CDS Start-End: 235-5271
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacc

SEQ ID NO: 121452 - DNA, 6528 bp, Homo sapiens
  Payload ID: 3813
  Gene Symbol: COL4A6
  Gene Name: collagen, type IV, alpha 6
  ENST ID: ENST00000538570
  CDS Start-End: 235-5136
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtg

SEQ ID NO: 121453 - DNA, 6627 bp, Homo sapiens
  Payload ID: 3813
  Gene Symbol: COL4A6
  Gene Name: collagen, type IV, alpha 6
  ENST ID: ENST00000621266
  CDS Start-End: 235-5235
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaacatgtg

SEQ ID NO: 121454 - DNA, 3059 bp, Homo sapiens
  Payload ID: 3814
  Gene Symbol: COL9A1
  Gene Name: collagen, type IX, alpha 1
  Uniprot ID: P20849
  ENST ID: ENST00000320755
  CDS Start-End: 158-2194
cgcgcgcctcccgggcctggacgctttggcaaccgctactcccgggggtgctttttctgcagggacgaagtgccacctatgctagtggcgggtctggaagcctagaggggaaccaggctgcagagccgggccaagggattagcggcgggcggcgggcatggcctggactgcgcgggaccgcggggccctggggctgctgctgttggggctctgcttgtgcgcggctcaaagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttct

SEQ ID NO: 121455 - DNA, 4761 bp, Homo sapiens
  Payload ID: 3814
  Gene Symbol: COL9A1
  Gene Name: collagen, type IX, alpha 1
  Uniprot ID: P20849
  ENST ID: ENST00000357250
  CDS Start-End: 160-2925
cctttgcttttagccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 121456 - DNA, 1372 bp, Homo sapiens
  Payload ID: 3814
  Gene Symbol: COL9A1
  Gene Name: collagen, type IX, alpha 1
  Uniprot ID: P20849
  ENST ID: ENST00000370496
  CDS Start-End: 147-1133
ccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgataccagtccttgattttgtccctggaatatgaagtgaagtaagaaatggcgtctgttcttagcataccatggtgcatcactcaagttactcttcaagttaccactttatgtgttttccaaaaactaaagacttttctaaatgaaagaaagcactcgaaaacctataattatgatttccaagaatttttgactacagtttaagacatatccttcattttgaaagaaaaataaataactggatttttactgtta

SEQ ID NO: 121457 - DNA, 319 bp, Homo sapiens
  Payload ID: 3815
  Gene Symbol: COL9A2
  Gene Name: collagen, type IX, alpha 2
  ENST ID: ENST00000372736
  CDS Start-End: 71-319
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacgggcctcctggacctgttggcctccctggtgagattggaatccgaggccccaagggggaccctggaccagatggaccatcggggcccccaggaccccct

SEQ ID NO: 121458 - DNA, 2862 bp, Homo sapiens
  Payload ID: 3815
  Gene Symbol: COL9A2
  Gene Name: collagen, type IX, alpha 2
  Uniprot ID: Q14055
  ENST ID: ENST00000372748
  CDS Start-End: 98-2167
ctgcccgcgaacagccagcgctggaggagcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactaggata

SEQ ID NO: 121459 - DNA, 677 bp, Homo sapiens
  Payload ID: 3815
  Gene Symbol: COL9A2
  Gene Name: collagen, type IX, alpha 2
  ENST ID: ENST00000417105
  CDS Start-End: 1-677
gtctcccttccgagggccgccgggggctgcgggcgcgcggagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccag

SEQ ID NO: 121460 - DNA, 548 bp, Homo sapiens
  Payload ID: 3815
  Gene Symbol: COL9A2
  Gene Name: collagen, type IX, alpha 2
  ENST ID: ENST00000427563
  CDS Start-End: 1-548
ggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagg

SEQ ID NO: 121461 - DNA, 2485 bp, Homo sapiens
  Payload ID: 3816
  Gene Symbol: COL9A3
  Gene Name: collagen, type IX, alpha 3
  Uniprot ID: Q14050
  ENST ID: ENST00000343916
  CDS Start-End: 4-2058
gccatggccgggccgcgcgcgtgcgccccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccctggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctcccata

SEQ ID NO: 121462 - DNA, 596 bp, Homo sapiens
  Payload ID: 3816
  Gene Symbol: COL9A3
  Gene Name: collagen, type IX, alpha 3
  ENST ID: ENST00000452372
  CDS Start-End: 24-596
ggtgggtaggggtggagggtgtcatgtggtggtcctccacccagaatgccggcactgagggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcag

SEQ ID NO: 121463 - DNA, 8471 bp, Homo sapiens
  Payload ID: 3817
  Gene Symbol: COL5A1
  Gene Name: collagen, type V, alpha 1
  Uniprot ID: P20908
  ENST ID: ENST00000371817
  CDS Start-End: 415-5931
ggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctggggagcccgggccacgtggtctgcttgggccgaaggggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaaa

SEQ ID NO: 121464 - DNA, 628 bp, Homo sapiens
  Payload ID: 3817
  Gene Symbol: COL5A1
  Gene Name: collagen, type V, alpha 1
  ENST ID: ENST00000371820
  CDS Start-End: 1-628
caggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaagggagtaaaatggcccgctggcccaaagagcagccttccacctggtatagtcagtacaagcgggggtccctgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgct

SEQ ID NO: 121465 - DNA, 8437 bp, Homo sapiens
  Payload ID: 3817
  Gene Symbol: COL5A1
  Gene Name: collagen, type V, alpha 1
  ENST ID: ENST00000618395
  CDS Start-End: 384-5900
ccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctggggagcccgggccacgtggtctgcttgggccgaaggggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaagggagtaaaatggcccgctggcccaaagagcagccttccacctggtatagtcagtacaagcgggggtccctgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgt

SEQ ID NO: 121466 - DNA, 6949 bp, Homo sapiens
  Payload ID: 3818
  Gene Symbol: COL5A2
  Gene Name: collagen, type V, alpha 2
  Uniprot ID: P05997
  ENST ID: ENST00000374866
  CDS Start-End: 276-4775
gaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaataccaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtgccaaaggcccaacgggctctccaggtacctctggtcctcctggctcagcagggcctcctggatctccaggacctcagggtagcactggtcctcagggaattcgaggccaaccgggtgatccaggagttccaggtttcaaaggagaagctggcccaaaaggggaaccagggccacatggtattcagggtccgataggcccacccggtgaagaaggcaaaagaggtcccagaggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggtgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaataaaagcctgcccagaccatt

SEQ ID NO: 121467 - DNA, 6399 bp, Homo sapiens
  Payload ID: 3818
  Gene Symbol: COL5A2
  Gene Name: collagen, type V, alpha 2
  ENST ID: ENST00000618828
  CDS Start-End: 906-4244
gaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaataccaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggtgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaata

SEQ ID NO: 121468 - DNA, 6174 bp, Homo sapiens
  Payload ID: 3819
  Gene Symbol: COL5A3
  Gene Name: collagen, type V, alpha 3
  Uniprot ID: P25940
  ENST ID: ENST00000264828
  CDS Start-End: 87-5324
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagagaggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcccgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcctggccccccaccgccaggccatagggcataatttgcatctcaaatctgagaataaactgatgaactgtg

SEQ ID NO: 121469 - DNA, 4238 bp, Homo sapiens
  Payload ID: 3820
  Gene Symbol: COL6A1
  Gene Name: collagen, type VI, alpha 1
  Uniprot ID: P12109
  ENST ID: ENST00000361866
  CDS Start-End: 115-3201
tccttgccctccgctctcactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 121470 - DNA, 3251 bp, Homo sapiens
  Payload ID: 3820
  Gene Symbol: COL6A1
  Gene Name: collagen, type VI, alpha 1
  ENST ID: ENST00000612273
  CDS Start-End: 83-3163
cagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccg

SEQ ID NO: 121471 - DNA, 3461 bp, Homo sapiens
  Payload ID: 3821
  Gene Symbol: COL6A2
  Gene Name: collagen, type VI, alpha 2
  Uniprot ID: P12110
  ENST ID: ENST00000300527
  CDS Start-End: 105-3164
cggccgcggttccctccctgctgcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 121472 - DNA, 3446 bp, Homo sapiens
  Payload ID: 3821
  Gene Symbol: COL6A2
  Gene Name: collagen, type VI, alpha 2
  Uniprot ID: P12110
  ENST ID: ENST00000310645
  CDS Start-End: 83-2569
gcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactccc

SEQ ID NO: 121473 - DNA, 3101 bp, Homo sapiens
  Payload ID: 3821
  Gene Symbol: COL6A2
  Gene Name: collagen, type VI, alpha 2
  Uniprot ID: P12110
  ENST ID: ENST00000397763
  CDS Start-End: 28-2784
gacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactcccgtc

SEQ ID NO: 121474 - DNA, 3430 bp, Homo sapiens
  Payload ID: 3821
  Gene Symbol: COL6A2
  Gene Name: collagen, type VI, alpha 2
  Uniprot ID: P12110
  ENST ID: ENST00000409416
  CDS Start-End: 64-2550
ctgggggtgtctgagcgacccccacccctgttgcaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactcccgtc

SEQ ID NO: 121475 - DNA, 919 bp, Homo sapiens
  Payload ID: 3821
  Gene Symbol: COL6A2
  Gene Name: collagen, type VI, alpha 2
  ENST ID: ENST00000436769
  CDS Start-End: 379-919
ggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggccc

SEQ ID NO: 121476 - DNA, 750 bp, Homo sapiens
  Payload ID: 3821
  Gene Symbol: COL6A2
  Gene Name: collagen, type VI, alpha 2
  ENST ID: ENST00000413758
  CDS Start-End: 1-750
ggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgggtctgaggtctccccggtaccccccgatgaccctgccacccccccagactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaac

SEQ ID NO: 121477 - DNA, 10749 bp, Homo sapiens
  Payload ID: 3822
  Gene Symbol: COL6A3
  Gene Name: collagen, type VI, alpha 3
  Uniprot ID: P12111
  ENST ID: ENST00000295550
  CDS Start-End: 454-9987
gcttgtagggtgaagacagaattcagagggtgacatcagcctgagcgggggccagaagaaacagagtggaggagtctggtttcatttacagttttgggtcagttctgcagtgaggagggggagaggaggggtccgggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagtttcctggg

SEQ ID NO: 121478 - DNA, 8625 bp, Homo sapiens
  Payload ID: 3822
  Gene Symbol: COL6A3
  Gene Name: collagen, type VI, alpha 3
  ENST ID: ENST00000347401
  CDS Start-End: 227-7936
ccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgccctttccacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggattta

SEQ ID NO: 121479 - DNA, 9963 bp, Homo sapiens
  Payload ID: 3822
  Gene Symbol: COL6A3
  Gene Name: collagen, type VI, alpha 3
  Uniprot ID: P12111
  ENST ID: ENST00000353578
  CDS Start-End: 286-9201
aagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagtttcctggg

SEQ ID NO: 121480 - DNA, 3464 bp, Homo sapiens
  Payload ID: 3822
  Gene Symbol: COL6A3
  Gene Name: collagen, type VI, alpha 3
  Uniprot ID: P12111
  ENST ID: ENST00000392003
  CDS Start-End: 286-3396
aagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgccctta

SEQ ID NO: 121481 - DNA, 4037 bp, Homo sapiens
  Payload ID: 3822
  Gene Symbol: COL6A3
  Gene Name: collagen, type VI, alpha 3
  Uniprot ID: P12111
  ENST ID: ENST00000392004
  CDS Start-End: 256-3969
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgccctta

SEQ ID NO: 121482 - DNA, 8916 bp, Homo sapiens
  Payload ID: 3822
  Gene Symbol: COL6A3
  Gene Name: collagen, type VI, alpha 3
  Uniprot ID: P12111
  ENST ID: ENST00000409809
  CDS Start-End: 1-8916
atgaggaaacatcggcacttgcccttagtggccgtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaa

SEQ ID NO: 121483 - DNA, 2379 bp, Homo sapiens
  Payload ID: 3822
  Gene Symbol: COL6A3
  Gene Name: collagen, type VI, alpha 3
  ENST ID: ENST00000433762
  CDS Start-End: 256-2379
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatc

SEQ ID NO: 121484 - DNA, 8628 bp, Homo sapiens
  Payload ID: 3822
  Gene Symbol: COL6A3
  Gene Name: collagen, type VI, alpha 3
  Uniprot ID: P12111
  ENST ID: ENST00000472056
  CDS Start-End: 227-7939
ccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggattta

SEQ ID NO: 121485 - DNA, 652 bp, Homo sapiens
  Payload ID: 3822
  Gene Symbol: COL6A3
  Gene Name: collagen, type VI, alpha 3
  ENST ID: ENST00000491233
  CDS Start-End: 1-522
ccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaaga

SEQ ID NO: 121486 - DNA, 9214 bp, Homo sapiens
  Payload ID: 3823
  Gene Symbol: COL6A5
  Gene Name: collagen, type VI, alpha 5
  ENST ID: ENST00000265379
  CDS Start-End: 495-8330
aaatggcgattcctctgtctaagtagtagaagtgaccgcagctcggctgctagtaaagattgcccttggtttctgagaaattctgactccctaagttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggcacgaggcgttcgctgcgggaatccacctgcagctgtgcggcgcggaccagggcgtgcggcgcggaccagggcttccggcgcgcgctctatccaactgcgccgcgggcgcccgagaggcgcgcgtttactgcgctcaggagctcggtgcagcctcttctggagagttgggggcggtttccagggtccggagtgtcccctgaccccgggaaagctggaacaaaagtaaaaatcttcactaacaaaatgaagatcttgctaattatatttgtcctaatcatttggactgaaacattggcagaccagagcccagggccaggccctgtgtatgcagatgtcgtgtttctggtggacagctccgatcacctgggacctaagtcattcccattcgtgaaaacgttcatcaacaaaatgatcaacagtctccccatagaggccaacaaataccgtgtagccctggcccagtacagcgacgagtttcacagtgaattccatctgagcaccttcaaaggcagaagccccatgctgaaccacctcaagaagaactttcagttcattggcgggtccctgcagataggaaaggctcttcaggaggctcataggacctacttctctgcacccataaatgggagagacaggaaacagtttcccccaattttggtggtcctggcttcggctgagtctgaggatgaagtggaagaggcttcgaaagccctgcagaaagacggggtgaaaattatctccgtgggggtgcagaaagcttctgaggaaaatctgaaggccatggccacatcccatttccatttcaaccttcggacaatcagagacctcagcacattttcccaaaacatgacacagatcatcaaggatgtaaccaagtataaggagggagccgtcgatgctgatatgcaagttcacttccccatatcctgtcagaaagattcactcgctgacctcgtgttcctggtggatgagtcacttgggaccggaggaaatttaaggcatcttcagaccttccttgagaacattaccagctccatggatgtgaaggaaaattgcatgcgacttggactgatgagttacagcaatagtgccaagactatttcttttcttaaatcaagcacaacccaatctgaatttcagcagcaaatcaagaatctttctatccaagttgggaaatccaatacaggggctgccattgatcagatgagaagagacggcttctcagagtcatatggcagcagaagagcacaaggagtgcctcagattgcagttctggtcacccacagaccatcagatgatgaggtgcatgatgctgcgctgaaccttcgactggaggatgtaaacgtgtttgccttgagcatccaaggggctaacaatacccagttagaagaaatagtgtcttatcctccagaacagacaatttccacgctgaagtcctatgcagacttagaaacttacagtacaaagttcctgaaaaagctccagaatgaaatatggtcccaaatttctacttatgctgaacaaaggaatcttgataaaactggctgtgtggatacaaaagaggctgatatccacttcctcattgatggctcaagcagcatccaggagaaacagtttgagcaaatcaagagatttatgttggaagtgacagaaatgtttagcattggcccagacaaagtccgagttggagttgtgcagtattcagatgacacagaagtggaattttatatcactgactattctaatgatattgacttaagaaaggctatttttaacattaagcaactaactggtggaacttatactgggaaagctctggattacatactgcaaataataaaaaatggaatgaaggatagaatgagcaaggttccctgttacctcattgtgttgactgatgggatgtccacagacagagtcgtggaacctgctaagagactaagggctgagcaaatcactgttcatgcagttggcattggggcagctaataaaatagaactgcaagaaattgctgggaaagaagaaagggttagctttgggcagaactttgatgctttgaaaagcataaaaaatgaagtcgttcgtgaaatctgcgctgaaaaaggatgtgaagacatgaaggccgacatcatgtttctggtggacagttcttggagtataggaaatgaaaattttaggaaaatgaaaatcttcatgaaaaacctgttaactaaaattcaaattggtgcagacaaaacccagattggtgttgttcagttcagtgataaaactaaggaagagttccagcttaatagatattttacacagcaagaaatttctgatgcaatagatagaatgtctctcatcaatgaaggcactttaactggaaaggcactaaattttgtaggtcaatacttcacccactccaagggggcccgtttgggggccaaaaaatttctcatcctcatcacagatggagtagcgcaggatgatgtgagagatcctgctagaattcttcggggcaaagatgtgaccatcttctctgtaggagtatacaatgccaatagatctcagctagaagagatcagtggggatagcagcctagtttttcatgttgagaacttcgatcatctaaaggcactagaaaggaaacttatctttcgtgtgtgtgctctccatgattgtaaaaggattacactactagacgttgtgtttgtgctggatcattcaggtagcataaaaaaacaatatcaagatcacatgattaacctaactatccatttggtgaagaaagcagatgttggcagggaccgagttcagtttggagccctcaaatactctgaccaacctaacatccttttctaccttaatacatactcgaacagatcagcaataattgagaatctgcggaagcgcagggacactggagggaacacctacactgccaaggctctcaagcacgcaaatgccctgtttacagaggaacatggcagccgcatcaagcaaaatgtgaagcagatgctgattgtcatcaccgatggggaatcccatgaccatgatcagctcaatgacacagcattggaactgagaaacaaaggcatcaccatctttgcagtgggtgtaggaaaggccaaccaaaaggaacttgagggtatggcagggaataaaaacaatactatctatgtagataattttgacaaactgaaagatgttttcacacttgttcaagaacgtatgtgtactgaagcaccagaggtctgtcatcttcaggaagctgacgtgattttcctttgcgatggctctgacagggtatctaattcagattttgtaaccatgacaactttcttgtcagacttaatcgataattttgacattcagtctcaaagaatgaaaattggtatggctcaatttggaagcaactaccagagtattattgagttgaaaaactctctgactaaaacccagtggaagactcaaattcagaatgtctccaagagcggtggatttccaagaattgactttgcccttaaaaaagtgagcaatatgtttaatctacatgctggtgggagaagaaatgctggtgtcccccaaactttggttgttatcacatctggagatcctcgctatgatgtggcagatgcagtaaaaaccctgaaggaccttggaatttgtgtcctggttttgggcataggagatgtttataaggaacatctcctgccaataacaggcaattctgaaaaaataatcacttttcaagactttgataaattaaagaatgtggatgtgaaaaaaagaatcatccgtgaaatctgccagagctgtgggaaaaccaattgctttatggacatagtggttgggtttgacatctccactcatgtgcaggggcagcctttgttccagggccacccccagctggaatcctacctcccaggcatcttagaagacatcagctctatcaagggggtgagctgtggggctggcacagaggcacaggtgagcttggcgtttaaggtgaacagtgaccaaggattccctgccaagttccaaatctatcagaaagcagtgtttgacagcttgctgcaagtcaacgtcagtgggccaactcatctgaacgcacagttcttgcggtctctttgggacacatttaaggataaatctgcatcccggggccaggtgctgcttattttttcagacggtctccagagtgaaagcaacataatgcttgaaaatcaatcagacaggctcagagaagcaggacttgatgctctgctggtagtgtcccttaacacaactgctcatcatgagttttctagctttgaatttggaaaaagattcgattacaggactcatctgactattggaatgagagaactgggcaaaaaactatcacagtacctgggaaatattgcagagaggacttgctgctgtacattctgcaaatgtccaggaattccaggacctcatgggacccgaggactacaagccatgaagggttctcaaggtctgaaaggcagcagaggacacaggggagaggatggaaaccctggagtacgaggagacacaggaccccaaggagacaaagggattgcaggatgtccaggggcgtggggtcagaagggactcaaaggattttctggacctaagggaggtcatggagacgatgggattgatggacttgatggggaagagggctgtcatggatttcctggaataaaaggagaaaaaggtgatccaggatctcagggcagcccaggttccagaggtgcccctgggcagtatggagagaagggcttcccaggggatccgggtaatccaggacaaaacaataacatcaaaggacaaaagggctccaaaggagaacaaggaagacaaggtagaagtggacagaaaggggtgcaaggcagtcctagttccagaggcagcaggggaagagaaggtcaaaggggactccgaggtgtctcaggagaaccaggaaatcctggacctacaggcacattgggagctgaaggattacaaggcccacaggggtcacagggaaatcctggcagaaaaggagaaaaaggaagccaggggcagaaaggacctcagggttctcctgggctaatgggagctaaagggagcactggaagacctggacttttggggaaaaaaggagagcctggacttcctggagatctagggccagtggggcaaactgggcagcgaggaagacagggagattctggcatcccaggctacggtcagatgggacgaaaaggagtaaagggcccaagaggattccctggagatgcggggcagaagggtgatattggtaatcctggaattcctgggggacctggacccaaaggatttaggggactagcactcactgtaggcttgaaaggtgaagagggatctcgaggactcccaggccctcctggacagagaggcattaaaggcatggcagggcagcctgtatattctcaatgtgatctgatccggtttttgcgggaacatagtcttttcaaaaatgcatatccaacagagctagtatttgctctggacaattcctacgatgtcacagaagagagctttaataaaacacgggacatcatcacttccattgtcaatgaccttaacatcagggaaaataactgtcctgtgggagcaagagttgccatggtttcctataactcaggcaccagctatctcatccgctggtctgactacaataggaagaagcagctcctccagcagctttcccaaataaaatatcaagacaccacagagccccgagatgttggtaatgcaatgaggtttgtgacccgcaacgtgttcaagcggacgtatgcaggagccaacgtgaggagagttgctgtgttttttagcaatggtcaaacagccagtaggtcatccatcatcacggccaccatggagtttagtgccctggatatcagtccaacagtctttgcttttgatgagagagttttccttgaagcttttgggtttgacaacactggaacatttcaggtgattccagttcctccaaatggggaaaatcaaacattagaaagacttcggcgctgtgcactttgctatgataaatgttttccaaatgcttgcattcgagaggctttcttacctgaagattcatacatggatgtagtcttcctcatagacaattctcggaatatagcaaaggatgagtttaaggctgtgaaagccttggtgagctcagtgattgacaacttcaacattgcttcagaccctttaatctcagactctggtgataggattgctttgttgagctattctccttgggaaagttccaggagaaagatgggtacagtaaaaacagagtttgatttcatcacttatgacaaccaactcctaatgaagaatcacatccagacttccttccaacagctaaatggagaagcaacaattggtcgtgccctactgtggaccactgaaaatctttttccagaaacaccctatctaagaaaacacaaggtcatctttgtggtctcagctggagaaaattatgagagaaaagaatttgtaaaaatgatggctttgagggctaagtgtcaaggctacgtcatatttgtgatttctctgggctctacacgtaaggatgacatggaggagttagccagctacccacttgatcaacacctgatacagcttgggagaatacataaaccagatctgaattatattgcgaagttcttaaagccatttttatactcggtcaggcggggattcaatcagtacccaccaccgatgcttgaggatgcctgtagactcatcaatttaggaggagagaatattcaaaatgatggtttccaatttgttactgagctacaagaggattttttgggaggtaatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacattgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaagtttgtcaagccatttgtccatttaatcagacgtgccatcaacaaatatcccaccgaagatatgaaagccacatgtgttaacatgacctctcccaacccagagaacggtggcacagaaaacactgtattacttcttcctgggatatatgaaataaagacagaaaatggtgatctgtttgatgaatttgattcccaggcacaacatctccttgtattagggaacaatcatagtagtggttctgagacagctactgatttgatgcagaagttatatctgctcttttcaactgagaaactggcaatgaaagacaaggaaaaagcacatttagaagaaatttcagctctagtggttgataaacagcaagaaaaagaagataaggaaatggaagctacagacatctgaagcatcttacctaagaattcagtaattaatccaatactttcgtcatagtgattcatactctatgtttatagaacatggtgaagatacaaggtcatcataggagaaaagaagatagctccactgacatgtataatcccatgtggttctaaccagaatgtataatcatctgttagaggtactgtggtaaatgacagggacttttcacaaaaacaattggctaatagcatgctaaatttgttctccatctcaaatcttgaggagaagaattttcggagtgaagacatcagtaagaagacctgacaaaccaggaatgatttcatttctcctgagaactggggaaaccgacctataagagttaacttttctttgaaagctctgcacagttcaggcatcaattttgatgatgtatctgcctgtaaaagattgtcattattttcaacacatctgtatctcagattggactcctctaaaagcatttggaattggaatttcctaggaatatcttctactaattcttaaaactggaaagccatgcccatgtcatcggttctggggtgaccctaacatttcatctagcagtgattgtcttctaaaacccacctgtcaggctgctatgacccatagttaatgctttctcttcaccaggacattgacaaaagaatggaattggtgaaaaagaaaaaagtgataagaggctaattttatgaaccatattttttgctgtaatcttttgtttaaattttagcagctttgctttgtgtatactgaatttttgcagcaaaagaattacggaaaagcacagatactctatatgaccagagatgttcttgggaattacaatgtagcaagagataatttctaaaataaaaacaagtctgacttgg

SEQ ID NO: 121487 - DNA, 9226 bp, Homo sapiens
  Payload ID: 3823
  Gene Symbol: COL6A5
  Gene Name: collagen, type VI, alpha 5
  Uniprot ID: A8TX70
  ENST ID: ENST00000312481
  CDS Start-End: 495-8342
aaatggcgattcctctgtctaagtagtagaagtgaccgcagctcggctgctagtaaagattgcccttggtttctgagaaattctgactccctaagttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggcacgaggcgttcgctgcgggaatccacctgcagctgtgcggcgcggaccagggcgtgcggcgcggaccagggcttccggcgcgcgctctatccaactgcgccgcgggcgcccgagaggcgcgcgtttactgcgctcaggagctcggtgcagcctcttctggagagttgggggcggtttccagggtccggagtgtcccctgaccccgggaaagctggaacaaaagtaaaaatcttcactaacaaaatgaagatcttgctaattatatttgtcctaatcatttggactgaaacattggcagaccagagcccagggccaggccctgtgtatgcagatgtcgtgtttctggtggacagctccgatcacctgggacctaagtcattcccattcgtgaaaacgttcatcaacaaaatgatcaacagtctccccatagaggccaacaaataccgtgtagccctggcccagtacagcgacgagtttcacagtgaattccatctgagcaccttcaaaggcagaagccccatgctgaaccacctcaagaagaactttcagttcattggcgggtccctgcagataggaaaggctcttcaggaggctcataggacctacttctctgcacccataaatgggagagacaggaaacagtttcccccaattttggtggtcctggcttcggctgagtctgaggatgaagtggaagaggcttcgaaagccctgcagaaagacggggtgaaaattatctccgtgggggtgcagaaagcttctgaggaaaatctgaaggccatggccacatcccatttccatttcaaccttcggacaatcagagacctcagcacattttcccaaaacatgacacagatcatcaaggatgtaaccaagtataaggagggagccgtcgatgctgatatgcaagttcacttccccatatcctgtcagaaagattcactcgctgacctcgtgttcctggtggatgagtcacttgggaccggaggaaatttaaggcatcttcagaccttccttgagaacattaccagctccatggatgtgaaggaaaattgcatgcgacttggactgatgagttacagcaatagtgccaagactatttcttttcttaaatcaagcacaacccaatctgaatttcagcagcaaatcaagaatctttctatccaagttgggaaatccaatacaggggctgccattgatcagatgagaagagacggcttctcagagtcatatggcagcagaagagcacaaggagtgcctcagattgcagttctggtcacccacagaccatcagatgatgaggtgcatgatgctgcgctgaaccttcgactggaggatgtaaacgtgtttgccttgagcatccaaggggctaacaatacccagttagaagaaatagtgtcttatcctccagaacagacaatttccacgctgaagtcctatgcagacttagaaacttacagtacaaagttcctgaaaaagctccagaatgaaatatggtcccaaatttctacttatgctgaacaaaggaatcttgataaaactggctgtgtggatacaaaagaggctgatatccacttcctcattgatggctcaagcagcatccaggagaaacagtttgagcaaatcaagagatttatgttggaagtgacagaaatgtttagcattggcccagacaaagtccgagttggagttgtgcagtattcagatgacacagaagtggaattttatatcactgactattctaatgatattgacttaagaaaggctatttttaacattaagcaactaactggtggaacttatactgggaaagctctggattacatactgcaaataataaaaaatggaatgaaggatagaatgagcaaggttccctgttacctcattgtgttgactgatgggatgtccacagacagagtcgtggaacctgctaagagactaagggctgagcaaatcactgttcatgcagttggcattggggcagctaataaaatagaactgcaagaaattgctgggaaagaagaaagggttagctttgggcagaactttgatgctttgaaaagcataaaaaatgaagtcgttcgtgaaatctgcgctgaaaaaggatgtgaagacatgaaggccgacatcatgtttctggtggacagttcttggagtataggaaatgaaaattttaggaaaatgaaaatcttcatgaaaaacctgttaactaaaattcaaattggtgcagacaaaacccagattggtgttgttcagttcagtgataaaactaaggaagagttccagcttaatagatattttacacagcaagaaatttctgatgcaatagatagaatgtctctcatcaatgaaggcactttaactggaaaggcactaaattttgtaggtcaatacttcacccactccaagggggcccgtttgggggccaaaaaatttctcatcctcatcacagatggagtagcgcaggatgatgtgagagatcctgctagaattcttcggggcaaagatgtgaccatcttctctgtaggagtatacaatgccaatagatctcagctagaagagatcagtggggatagcagcctagtttttcatgttgagaacttcgatcatctaaaggcactagaaaggaaacttatctttcgtgtgtgtgctctccatgattgtaaaaggattacactactagacgttgtgtttgtgctggatcattcaggtagcataaaaaaacaatatcaagatcacatgattaacctaactatccatttggtgaagaaagcagatgttggcagggaccgagttcagtttggagccctcaaatactctgaccaacctaacatccttttctaccttaatacatactcgaacagatcagcaataattgagaatctgcggaagcgcagggacactggagggaacacctacactgccaaggctctcaagcacgcaaatgccctgtttacagaggaacatggcagccgcatcaagcaaaatgtgaagcagatgctgattgtcatcaccgatggggaatcccatgaccatgatcagctcaatgacacagcattggaactgagaaacaaaggcatcaccatctttgcagtgggtgtaggaaaggccaaccaaaaggaacttgagggtatggcagggaataaaaacaatactatctatgtagataattttgacaaactgaaagatgttttcacacttgttcaagaacgtatgtgtactgaagcaccagaggtctgtcatcttcaggaagctgacgtgattttcctttgcgatggctctgacagggtatctaattcagattttgtaaccatgacaactttcttgtcagacttaatcgataattttgacattcagtctcaaagaatgaaaattggtatggctcaatttggaagcaactaccagagtattattgagttgaaaaactctctgactaaaacccagtggaagactcaaattcagaatgtctccaagagcggtggatttccaagaattgactttgcccttaaaaaagtgagcaatatgtttaatctacatgctggtgggagaagaaatgctggtgtcccccaaactttggttgttatcacatctggagatcctcgctatgatgtggcagatgcagtaaaaaccctgaaggaccttggaatttgtgtcctggttttgggcataggagatgtttataaggaacatctcctgccaataacaggcaattctgaaaaaataatcacttttcaagactttgataaattaaagaatgtggatgtgaaaaaaagaatcatccgtgaaatctgccagagctgtgggaaaaccaattgctttatggacatagtggttgggtttgacatctccactcatgtgcaggggcagcctttgttccagggccacccccagctggaatcctacctcccaggcatcttagaagacatcagctctatcaagggggtgagctgtggggctggcacagaggcacaggtgagcttggcgtttaaggtgaacagtgaccaaggattccctgccaagttccaaatctatcagaaagcagtgtttgacagcttgctgcaagtcaacgtcagtgggccaactcatctgaacgcacagttcttgcggtctctttgggacacatttaaggataaatctgcatcccggggccaggtgctgcttattttttcagacggtctccagagtgaaagcaacataatgcttgaaaatcaatcagacaggctcagagaagcaggacttgatgctctgctggtagtgtcccttaacacaactgctcatcatgagttttctagctttgaatttggaaaaagattcgattacaggactcatctgactattggaatgagagaactgggcaaaaaactatcacagtacctgggaaatattgcagagaggacttgctgctgtacattctgcaaatgtccaggaattccaggacctcatgggacccgaggactacaagccatgaagggttctcaaggtctgaaaggcagcagaggacacaggggagaggatggaaaccctggagtacgaggagacacaggaccccaaggagacaaagggattgcaggatgtccaggggcgtggggtcagaagggactcaaaggattttctggacctaagggaggtcatggagacgatgggattgatggacttgatggggaagagggctgtcatggatttcctggaataaaaggagaaaaaggtgatccaggatctcagggcagcccaggttccagaggtgcccctgggcagtatggagagaagggcttcccaggggatccgggtaatccaggacaaaacaataacatcaaaggacaaaagggctccaaaggagaacaaggaagacaaggtagaagtggacagaaaggggtgcaaggcagtcctagttccagaggcagcaggggaagagaaggtcaaaggggactccgaggtgtctcaggagaaccaggaaatcctggacctacaggcacattgggagctgaaggattacaaggcccacaggggtcacagggaaatcctggcagaaaaggagaaaaaggaagccaggggcagaaaggacctcagggttctcctgggctaatgggagctaaagggagcactggaagacctggacttttggggaaaaaaggagagcctggacttcctggagatctagggccagtggggcaaactgggcagcgaggaagacagggagattctggcatcccaggctacggtcagatgggacgaaaaggagtaaagggcccaagaggattccctggagatgcggggcagaagggtgatattggtaatcctggaattcctgggggacctggacccaaaggatttaggggactagcactcactgtaggcttgaaaggtgaagagggatctcgaggactcccaggccctcctggacagagaggcattaaaggcatggcagggcagcctgtatattctcaatgtgatctgatccggtttttgcgggaacatagtccttgctggaaagaaaaatgtccagcatatccaacagagctagtatttgctctggacaattcctacgatgtcacagaagagagctttaataaaacacgggacatcatcacttccattgtcaatgaccttaacatcagggaaaataactgtcctgtgggagcaagagttgccatggtttcctataactcaggcaccagctatctcatccgctggtctgactacaataggaagaagcagctcctccagcagctttcccaaataaaatatcaagacaccacagagccccgagatgttggtaatgcaatgaggtttgtgacccgcaacgtgttcaagcggacgtatgcaggagccaacgtgaggagagttgctgtgttttttagcaatggtcaaacagccagtaggtcatccatcatcacggccaccatggagtttagtgccctggatatcagtccaacagtctttgcttttgatgagagagttttccttgaagcttttgggtttgacaacactggaacatttcaggtgattccagttcctccaaatggggaaaatcaaacattagaaagacttcggcgctgtgcactttgctatgataaatgttttccaaatgcttgcattcgagaggctttcttacctgaagattcatacatggatgtagtcttcctcatagacaattctcggaatatagcaaaggatgagtttaaggctgtgaaagccttggtgagctcagtgattgacaacttcaacattgcttcagaccctttaatctcagactctggtgataggattgctttgttgagctattctccttgggaaagttccaggagaaagatgggtacagtaaaaacagagtttgatttcatcacttatgacaaccaactcctaatgaagaatcacatccagacttccttccaacagctaaatggagaagcaacaattggtcgtgccctactgtggaccactgaaaatctttttccagaaacaccctatctaagaaaacacaaggtcatctttgtggtctcagctggagaaaattatgagagaaaagaatttgtaaaaatgatggctttgagggctaagtgtcaaggctacgtcatatttgtgatttctctgggctctacacgtaaggatgacatggaggagttagccagctacccacttgatcaacacctgatacagcttgggagaatacataaaccagatctgaattatattgcgaagttcttaaagccatttttatactcggtcaggcggggattcaatcagtacccaccaccgatgcttgaggatgcctgtagactcatcaatttaggaggagagaatattcaaaatgatggtttccaatttgttactgagctacaagaggattttttgggaggtaatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacattgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaagtttgtcaagccatttgtccatttaatcagacgtgccatcaacaaatatcccaccgaagatatgaaagccacatgtgttaacatgacctctcccaacccagagaacggtggcacagaaaacactgtattacttcttcctgggatatatgaaataaagacagaaaatggtgatctgtttgatgaatttgattcccaggcacaacatctccttgtattagggaacaatcatagtagtggttctgagacagctactgatttgatgcagaagttatatctgctcttttcaactgagaaactggcaatgaaagacaaggaaaaagcacatttagaagaaatttcagctctagtggttgataaacagcaagaaaaagaagataaggaaatggaagctacagacatctgaagcatcttacctaagaattcagtaattaatccaatactttcgtcatagtgattcatactctatgtttatagaacatggtgaagatacaaggtcatcataggagaaaagaagatagctccactgacatgtataatcccatgtggttctaaccagaatgtataatcatctgttagaggtactgtggtaaatgacagggacttttcacaaaaacaattggctaatagcatgctaaatttgttctccatctcaaatcttgaggagaagaattttcggagtgaagacatcagtaagaagacctgacaaaccaggaatgatttcatttctcctgagaactggggaaaccgacctataagagttaacttttctttgaaagctctgcacagttcaggcatcaattttgatgatgtatctgcctgtaaaagattgtcattattttcaacacatctgtatctcagattggactcctctaaaagcatttggaattggaatttcctaggaatatcttctactaattcttaaaactggaaagccatgcccatgtcatcggttctggggtgaccctaacatttcatctagcagtgattgtcttctaaaacccacctgtcaggctgctatgacccatagttaatgctttctcttcaccaggacattgacaaaagaatggaattggtgaaaaagaaaaaagtgataagaggctaattttatgaaccatattttttgctgtaatcttttgtttaaattttagcagctttgctttgtgtatactgaatttttgcagcaaaagaattacggaaaagcacagatactctatatgaccagagatgttcttgggaattacaatgtagcaagagataatttctaaaataaaaacaagtctgacttgg

SEQ ID NO: 121488 - DNA, 1770 bp, Homo sapiens
  Payload ID: 3823
  Gene Symbol: COL6A5
  Gene Name: collagen, type VI, alpha 5
  ENST ID: ENST00000373157
  CDS Start-End: 1-1674
attggtcgtgccctactgtggaccactgaaaatctttttccagaaacaccctatctaagaaaacacaaggtcatctttgtggtctcagctggagaaaattatgagagaaaagaatttgtaaaaatgatggctttgagggctaagtgtcaaggctacgtcatatttgtgatttctctgggctctacacgtaaggatgacatggaggagttagccagctacccacttgatcaacacctgatacagcttgggagaatacataaaccagatctgaattatattgcgaagttcttaaagccatttttatactcggtcaggcggggattcaatcagtacccaccaccgatgcttgaggatgcctgtagactcatcaatttaggaggagagaatattcaaaatgatggtttccaatttgttactgagctacaagaggattttttgggaggtaatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacattgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaagtttgtcaagccatttgtccatttaatcagacgtgccatcaacaaatatcccaccgaagatatgaaagccacatgtgttaacatgacctctcccaacccagagaacggtggcacagaaaacactgtattacttcttcctgggatatatgaaataaagacagaaaatggtgatctgtttgatgaatttgattcccaggcacaacatctccttgtattagggaacaatcatagtagtggttctgagacagctactgatttgatgcagaagttatatctgctcttttcaactgagaaactggcaatgaaagacaaggaaaaagcacatttagaagaaatttcagctctagtggttgataaacagcaagaaaaagaagatggtgaagatacaaggtcatcataggagaaaagaagatagctccactgacatgtataatcccatgtggttctaaccagaatgtataatcatctgttagaggtactgtggtaaatgacaggg

SEQ ID NO: 121489 - DNA, 3138 bp, Homo sapiens
  Payload ID: 3823
  Gene Symbol: COL6A5
  Gene Name: collagen, type VI, alpha 5
  ENST ID: ENST00000512836
  CDS Start-End: 1-2335
agaaaaatgtccagcatatccaacagagctagtatttgctctggacaattcctacgatgtcacagaagagagctttaataaaacacgggacatcatcacttccattgtcaatgaccttaacatcagggaaaataactgtcctgtgggagcaagagttgccatggtttcctataactcaggcaccagctatctcatccgctggtctgactacaataggaagaagcagctcctccagcagctttcccaaataaaatatcaagacaccacagagccccgagatgttggtaatgcaatgaggtttgtgacccgcaacgtgttcaagcggacgtatgcaggagccaacgtgaggagagttgctgtgttttttagcaatggtcaaacagccagtaggtcatccatcatcacggccaccatggagtttagtgccctggatatcagtccaacagtctttgcttttgatgagagagttttccttgaagcttttgggtttgacaacactggaacatttcaggtgattccagttcctccaaatggggaaaatcaaacattagaaagacttcggcgctgtgcactttgctatgataaatgttttccaaatgcttgcattcgagaggctttcttacctgaagattcatacatggatgtagtcttcctcatagacaattctcggaatatagcaaaggatgagtttaaggctgtgaaagccttggtgagctcagtgattgacaacttcaacattgcttcagaccctttaatctcagactctggtgataggattgctttgttgagctattctccttgggaaagttccaggagaaagatgggtacagtaaaaacagagtttgatttcatcacttatgacaaccaactcctaatgaagaatcacatccagacttccttccaacagctaaatggagaagcaacaattggtcgtgccctactgtggaccactgaaaatctttttccagaaacaccctatctaagaaaacacaaggtcatctttgtggtctcagctggagaaaattatgagagaaaagaatttgtaaaaatgatggctttgagggctaagtgtcaaggctacgtcatatttgtgatttctctgggctctacacgtaaggatgacatggaggagttagccagctacccacttgatcaacacctgatacagcttgggagaatacataaaccagatctgaattatattgcgaagttcttaaagccatttttatactcggtcaggcggggattcaatcagtacccaccaccgatgcttgaggatgcctgtagactcatcaatttaggaggagagaatattcaaaatgatggtttccaatttgttactgagctacaagaggattttttgggaggtaatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacattgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaagtttgtcaagccatttgtccatttaatcagacgtgccatcaacaaatatcccaccgaagatatgaaagccacatgtgttaacatgacctctcccaacccagagaacggtggcacagaaaacactgtattatggtgaagatacaaggtcatcataggagaaaagaagatagctccactgacatgtataatcccatgtggttctaaccagaatgtataatcatctgttagaggtactgtggtaaatgacagggacttttcacaaaaacaattggctaatagcatgctaaatttgttctccatctcaaatcttgaggagaagaattttcggagtgaagacatcagtaagaagacctgacaaaccaggaatgatttcatttctcctgagaactggggaaaccgacctataagagttaacttttctttgaaagctctgcacagttcaggcatcaattttgatgatgtatctgcctgtaaaagattgtcattattttcaacacatctgtatctcagattggactcctctaaaagcatttggaattggaatttcctaggaatatcttctactaattcttaaaactggaaagccatgcccatgtcatcggttctggggtgaccctaacatttcatctagcagtgattgtcttctaaaacccacctgtcaggctgctatgacccatagttaatgctttctcttcaccaggacattgacaaaagaatggaattggtgaaaaagaaaaaagtgataagaggctaattttatgaaccatattttttgctgtaatcttttgtttaaattttagcagctttgctttgtgtatactgaatttttgcagcaaaagaattacggaaaagcacagatactctatatgaccagagatgttcttgggaattacaatgtagcaagagataatttctaaaataaaaacaagtctgacttgg

SEQ ID NO: 121490 - DNA, 1780 bp, Homo sapiens
  Payload ID: 3823
  Gene Symbol: COL6A5
  Gene Name: collagen, type VI, alpha 5
  ENST ID: ENST00000512482
  CDS Start-End: 1-1332
aatcagtacccaccaccgatgcttgaggatgcctgtagactcatcaatttaggaggagagaatattcaaaatgatggtttccaatttgttactgagctacaagaggattttttgggaggtaatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacattgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaagtttgtcaagccatttgtccatttaatcagacgtgccatcaacaaatatcccaccgaagatatgaaagccacatgtgttaacatgacctctcccaacccagagaacggtggcacagaaaacactgtattacttcttcctgggatatatgaaataaagacagaaaatggtgatctgtttgatgaatttgattcccaggcacaacatctccttgtattagggaacaatcatagtagtggttctgagacagctactgatttgatgcagaagttatatctgctcttttcaactgagaaactggcaatgaaagacaaggaaaaagcacatttagaagaaatttcagctctagtggttgataaacagcaagaaaaagaagatctctagccagcagcttgggttagttatatttggccagccctgctccctgaagccaatctgagtctcttcagaaaatatcagcttgtctttttcttgcactcatgaaagcttaatgactgagaatcactgagttgtactttgtctttttgcagataaggaaatggaagctacagacatctgaagcatcttacctaagaattcagtaattaatccaatactttcgtcatagtgattcatactctatgtttatagaacgtaagtttaccttaaagttaggccatgaaacagaaataatacaatctatctctgagttgttgaaaagttgaagatgatgcatataaagctcaaagtacacactatgcgtggaatataatcaactagtattatccctatttgaattatctaagtttgatcatctatttgacaattaaaaatataaatccattatatcaaa

SEQ ID NO: 121491 - DNA, 9581 bp, Homo sapiens
  Payload ID: 3824
  Gene Symbol: COL6A6
  Gene Name: collagen, type VI, alpha 6
  Uniprot ID: A6NMZ7
  ENST ID: ENST00000358511
  CDS Start-End: 32-6823
atttgaagttgaagatttttcaggtcataatatgatgttgctaattttgttcctcgtgataatttgttcccatatttctgtgaaccaagattccggccctgagtatgcagatgttgtgtttttggtggacagctctgatcgcctgggatccaagtccttcccatttgtgaaaatgttcatcaccaaaatgatcagcagtctccccatagaggccgacaaataccgtgtggccctggcccagtacagtgataaacttcacagtgaattccacctgagcaccttcaaaggcaggagccccatgctgaaccacctaaggaagaactttggattcattggcgggtccctgcagataggaaaggctcttcaggaggctcacaggacttatttctctgcacccgcaaatgggagagacaagaaacagtttcccccaattctagtggtcctggcttcatctgagtctgaggataatgtggaagaggcatcaaaggccctgcggaaagacggagtgaaaatcatctctgtaggggtgcagaaagcttctgaggaaaacctgaaggccatggccacgtctcagtttcatttcaaccttcggacagtcagagacctcagcatgttttcccaaaacatgacacacatcatcaaggatgtaataaagtacaaggagggagcagttgatgacatctttgtagaagcttgccaaggcccttctatggccgatgttgtgttcctattggatatgtcaatcaatggaagtgaggagaactttgactatcttaaaggattcttggaagaaagtgtatctgcccttgacataaaggaaaattgcatgagggttggccttgtggcctatagcaatgagacaaaagtgataaattcactgagcatgggcataaataagtcagaggttctccagcatatacagaacctttctccccgaactgggaaggcctatactggagctgccatcaaaaagctcaggaaggaagtttttagtgcacggaatggcagtcggaagaatcagggggtgccccagattgccgtgctggtgacccaccgagattcagaagacaacgtgacaaaagcagctgttaacctccgacgggagggtgtgaccatcttcaccctgggcatagagggcgccagcgacacccagttggaaaagatagcatcccaccctgctgagcagtatgtctccaaactgaagaccttcgctgacctggctgctcacaaccagacatttctgaagaagctgcggaaccaaataacacacacagtctctgtcttttcagagaggactgaaacgctcaaatctggttgtgtggacactgaggaagcagacatctatctgcttatcgatggctcagggagcacccaggccacagatttccatgaaatgaagacgttcctgtcagaggtggtagggatgttcaacattgctccccataaggtgcgggttggggccgttcagtatgctgacagctgggacttggaatttgagatcaataaatactccaacaagcaggatttgggaaaggccattgagaatatcaggcagatgggtgggaatacaaacacaggcgcagcactgaatttcacactgagtctgttgcaaaaagcaaagaagcagcgaggaaacaaagttccatgccaccttgttgtcctgacaaatggcatgtccaaggatagcatcttggagcctgcaaacagactgagagaagagcacatccgagtttatgctatcgggatcaaggaggccaaccaaacacagctgagagaaattgcaggagaggaaaagagagtgtattacgtgcatgactttgatgcattgaaagacataagaaaccaagttgttcaagaaatctgtactgaagaagcttgcaaagagatgaaagctgacatcatgtttctggtggacagttctggaagtataggacctgaaaacttcagcaaaatgaaaacatttatgaaaaacctggtgagcaagtctcagattggaccagatcgggtgcaaattggtgtagtccagttcagcgacatcaataaggaagagtttcagctcaacagattcatgtcccaaagcgacatttcaaatgcaatagaccaaatggctcacattggacaaaccaccctgactggtagtgccctgagctttgtgtctcagtacttcagccccaccaagggcgcccggcccaacatcagaaagtttctcatcctcatcacggatggtgaagctcaggacatagtaaaggaaccagcagtagtgcttcggcaagaaggtgtaatcatctattctgtgggagtgtttggctccaatgtcacccagcttgaggagatcagtgggaggcccgagatggttttttatgttgagaattttgacattctgcagcgcattgaagatgatcttgtttttggaatatgcagcccccgtgaagaatgcaagcggattgaagttttagacgttgtgtttgtcattgatagctctggcagtattgactatgatgagtataatatcatgaaggattttatgattggcttagtgaaaaaagctgatgtgggcaagaatcaggtccggtttggggctctgaagtatgctgatgacccagaggtgctgttttatctggatgactttggcacaaaactggaggtaatttcagtgctccagaatgaccaagccatgggtggcagtacttatactgctgaggcactgggcttctcagaccacatgttcactgaagcccggggcagccgcctgaacaagggggtcccccaagtcctcattgtgatcaccgatggggaatcccatgatgctgataaactcaatgccacggcaaaggccttgcgggacaaaggcattcttgtcctggctgtggggattgatggtgccaatcccgtggagctgttagccatggcaggatcaagcgacaagtacttcttcgtggagacttttggaggtctgaagggaatattttcagatgtgacagccagtgtctgcaactcttcaaaagtagattgtgaaattgacaaagtagatcttgttttccttatggatggttcaactagcattcagccaaatgacttcaagaaaatgaaggaatttctggcatctgttgttcaagactttgatgtcagcctcaacagagtgcgaataggagcggcccagtttagcgatacctatcacccggagtttccactgggaactttcataggtgaaaaagagatatcatttcagattgaaaacatcaagcagatctttggaaacacacacatcggtgctgcactcagggaggtggaacattacttcaggccagacatgggcagcaggataaatacaggtaccccacaggtgctgctggtccttacagatggccagtcccaagacgaggtggcccaggccgcggaagccctgagacacagaggtatcgacatctactccgtgggcattggggatgtggatgaccagcagctcattcagatcaccgggactgcagagaaaaaactgacagtgcacaacttcgatgaactgaagaaggtcaataaaaggatcgttcgcaacatctgtaccacagcgggtgaaagcaactgtttcgtggatgttgtggtgggatttgatgtctcaactcaggagaaagggcagactttgcttgaaggtcagccttggatggaaacctaccttcaagacatcttacgtgccatcagctccctcaatggagtaagctgtgaggtgggcacagagactcaggtcagtgtggcttttcaagtgaccaatgccatggaaaaatattctcccaagtttgagatctacagtgaaaacatactgaatagcttgaaggatataacagttaaaggaccatctcttctcaatgcaaacctcttggattctctatgggatacatttcagaataaatcagctgctcgaggaaaggtggtccttttattttcagatggattggatgatgatgttgagaaacttgaacaaaaatctgatgaacttagaaaagaaggcctgaatgccctcataactgttgctctggatggacctgctgattcaagtgacttggctgatcttccctatattgaatttgggaaaggatttgagtacaggacacagctctctattggcatgagagaacttggaagccggctgtcaaagcagctggtcaatgttgctgaaaggacatgctgctgtttgttctgcaagtgcattggaggagatggcacaatgggagatcctggaccaccagggaaaaggggacctccaggttttaaaggcagtgaaggctacctgggagaggagggaatcgctggagaaagaggagcccctggaccagtgggagagcaaggtactaagggatgctatggcaccaaaggtcctaagggaaacagaggactaaatggacaggagggagaagttggggaaaatggaattgacggattaaacggagaacagggtgataatggtcttcctggaagaaaaggagaaaagggagatgagggatctcagggaagcccagggaagagagggactcctggtgaccgtggagcaaagggcctgcgaggggatcccggagctcctggagttgacagtagcatagaaggacccacaggcttgaaaggagaacgtggaagacaaggcagaagaggctggccaggcccccccgggacaccaggctccagaagaaagacagcagctcatggcagaaggggacatacaggcccacagggaacagcaggcatcccaggaccagatggacttgaaggctccctgggacttaagggccctcagggcccaagaggagaggctggtgtgaaaggagaaaaaggaggtgtgggaagtaaaggtccccaggggcctccaggacccggaggagaggcagggaatcaaggccgtttgggaagccaaggaaataaaggagaacctggagatctgggagaaaaaggagctgttggctttcctggtcctcgtggcttgcagggcaatgatggcagtccaggttatggtagtgtcggacgcaagggagcaaagggacaagaaggattccctggagaaagtggacctaagggtgagattggggaccctggtggtccaggagagactgggctgaagggagctagaggcaaaatgatatctgctgggcttccaggagagatgggatcccctggggaaccaggacctcctggacgtaagggtgtgaaaggagccaaaggcttggcttcattttctacatgtgagctcattcagtatgtgcgagaccgcagtcctggcaggcatggaaaaccggaatgcccagtgcacccaaccgagttggtgtttgccctggaccactcccgggatgtcactgagcaggaatttgagcggatgaaggagatgatggctttcctggtgagagacattaaggtccgggagaacagctgccccgtgggagcgcacatcgccatcctctcctataactcccacgccaggcaccttgtgcgcttctcagacgcctacaagaagagtcaacttctcagagaaattgaaactattccttatgagagatcctctgccagcagggagattggcagagcaatgcggtttatttccaggaatgtcttcaagcggacgcttccgggggcacacacgagaaaaatcgccacatttttcagcagcggtcagtccgcggatgcccactccatcaccacggctgccatggagttcggcgcgcttgaaatcattcccgtggtgatcactttcagcaacgtgccctcggtcaggcgcgcatttgcgattgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgtgcaatcaacaaatatccaccaataaacttaaaaataaagtgcaacagacttaactctatagatccaaagcagcccccacgaccattccgaagctttgttcctggaccacttaaagctaccctcaaagaagatgtattacagaaggcaaaattctttcaagataaaaaatatctttcaagagtagcaagaagtggcagagatgatgctattcaaaattttatgagaagcacctcccatacctttaagaatggaaggatgatagaaagtgctcccaaacaacatgattaaaaaaatgcttgaacaacttagccttaggaagcatggtaagactctggacttaaatagtaactaaatctgctgccagaactcaagcaacagtttgtaggttatcaggtgacttgaccccctgcattcattggtattaagatatatcttgttcatttatttgaccactcctgacaattccagcactctacgactgatatgtcgaagaactgtttcattagaagacagaagaatgaaagaagtgttttgaaaagtctaatggagatataatttgaaggtaaaatttatatgatgtatgcatatgtgtacatgggtcaatgttaattcttttatctctgtccagttcattttctgcaaacccatcctcctttcctaatttagtaatgtctaatgctcatctatttagtcaaagttattttttaatgttttaagctactccaaaatttatcctagaaatggatgctgtttatatgtcgtatttttttaaaacgtgaccttctattccacttaaacacaccactgtgggagttgtttgcttggactgatgagaagagggtaattttctccatctctaaatcctcctgaactcactgaaaaactcattaattcccgcagaacataaattattgcttttgagctggaagttttctcttcattaggaagcttactgccattttgatggagcttgaagcccccattttgatggacttctagtctgtctttcctgttatggtcatttattaattttcactaatccatatattctttagacaaggagagtcaagaaactacttgtcatagatgaagctctgagttacttttacccatcaggtagctgtttagtcaataataaacagcaccaaaacaggattagcagagctcttaaaaacagccttaaatacacactgagtttagaaaaatgtaagaaaatcattgttttaatctacaaattcatatgcagttgcagagatgcaaaagagatcagagtaagttaaagtaggaaaggttttataaaagtattgatggctgtgtcctcatctgcatttttgtttttatgatagggctgatattttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaacaaatattcccttggtgacagattatttttagtattttgggccatcttttgaatcactaataggtgagagctctaaagcatgctgcaaatagaagttcctttttaaaaatccctaatattagtattttccctgatttacctctttctcctaaaagtggaaacagcaaaaattaagttgaatataaatttaataaagctatatttaacccaagaatcacacaagccaggatgcttcttggtttaaaaatgtgaattaatcgactgtaaaggaactgcctcccattatctctgcactgagctatgaatcaaactttttttttttaagtagaggtcaaaaggagatgcaacttaacacggcatcagattgtaatacttagaattcaaccaaataacttttttttaaaactggggcttttctgtggggcaaggggacagagaagaatgggtggtagcaggagataaggggagaaaaggatcatatctctgtcagcccactccatttttttttcttagcacttcccatatttatcagtcttacagcttatctatctaatggctccaggctgaagtccaatctcagcattacagtttatatagcaaaaaaaattttccccaacccccttggagactctaaatctgacttagtagctagaaaccctgtaaatatggtcttagcagacattaagggaaacaaagccaaggcaacatgacaatgccaaatttgcaatttctaccaatccactaagctatcaggcctagttagtccatcattcctaactttgacatttctgaacgactggcattttctgacagttttgttgtttacctgtctaaaaactaagtacagttggctctgtatctgtgggtgttccacatccatgaattcaaccgtggataaaaaatattcagaaaaagaaggatggttgtgtctgtactgaacatgtacagacatttttcttttcattctctaaacaatagagtataacaactatttagcatttacagtgtattatgtatcgcaagtgacctagaaataatttgaagtatatgagaagatgtgtgtagattatatgcaaatacaacgtcattttatgtaagagactagagcatctgtggg

SEQ ID NO: 121492 - DNA, 778 bp, Homo sapiens
  Payload ID: 3824
  Gene Symbol: COL6A6
  Gene Name: collagen, type VI, alpha 6
  ENST ID: ENST00000511332
  CDS Start-End: 1-778
tgaccaatgccatggaaaaatattctcccaagtttgagatctacagtgaaaacatactgaatagcttgaaggatataacagttaaaggaccatctcttctcaatgcaaacctcttggattctctatgggatacatttcagaataaatcagctgctcgaggaaaggtggtccttttattttcagatggattggatgatgatgttgagaaacttgaacaaaaatctgatgaacttagaaaagaaggcctgaatgccctcataactgttgctctggatggacctgctgattcaagtgacttggctgatcttccctatattgaatttgggaaaggatttgagtacaggacacagctctctattggcatgagagaacttggaagccggctgtcaaagcagctggtcaatgttgctgaaaggacatgctgctgtttgttctgcaagtgcattggaggagatggcacaatgggagatcctggaccaccagggaaaaggcttcatgtaaagagagtggtagatttttttaaaaaacaaggctcagaaagaatggaaagaaagggacctccaggttttaaaggcagtgaaggctacctgggagaggagggaatcgctggagaaagaggagcccctggaccagtgggagagcaaggtactaagggatgctatggcaccaaaggtcctaagggaaacagaggactaaatggacaggagggagaagttggggaaaatggaattgacggattaaacggagaacagggtgataatggtcttcctggaagaaa

SEQ ID NO: 121493 - DNA, 4353 bp, Homo sapiens
  Payload ID: 3824
  Gene Symbol: COL6A6
  Gene Name: collagen, type VI, alpha 6
  ENST ID: ENST00000506143
  CDS Start-End: 1-895
cctcaatggagtaagctgtgaggtgggcacagagactcaggtcagtgtggcttttcaagtgaccaatgccatggaaaaatattctcccaagtttgagatctacagtgaaaacatactgaatagcttgaaggatataacagttaaaggaccatctcttctcaatgcaaacctcttggattctctatgggatacatttcagaataaatcagctgctcgaggaaaggtggtccttttattttcagatggattggatgatgatgttgagaaacttgaacaaaaatctgatgaacttagaaaagaaggcctgaatgccctcataactgttgctctggatggacctgctgattcaagtgacttggctgatcttccctatattgaatttgggaaaggatttgagtacaggacacagctctctattggcatgagagaacttggaagccggctgtcaaagcagctggtcaatgttgctgaaaggacatgctgctgtttgttctgcaagtgcattggaggagatggcacaatgggagatcctggaccaccagggaaaaggggacctccaggttttaaaggcagtgaaggctacctgggagaggagggaatcgctggagaaagaggagcccctggaccagtgggagagcaaggtactaagggatgctatggcaccaaaggtcctaagggaaacagaggactaaatggacaggagggagaagttggggaaaatggaattgacggattaaacggagaacagggtgataatggtcttcctggaagaaaaggagaaaagggagatgagggatctcagggaagcccagggaagagagggactcctggtgaccgtggagcaaagggcctgcgaggggatcccgtaagtgcacgggctgcaaactggagttagggcttgattcccatccgtacttctgatagggagtctcgatttcaagggagctcctggagttgacagtagcatagaaggacccacaggcttgaaaggagaacgtggaagacaaggcagaagaggctggccaggcccccccgggacaccaggctccagaagaaagacagcagctcatggcagaaggggacatacaggcccacagggaacagcaggcatcccaggaccagatggacttgaaggctccctgggacttaagggccctcagggcccaagaggagaggctggtgtgaaaggagaaaaaggaggtgtgggaagtaaaggtccccaggggcctccaggacccggaggagaggcagggaatcaaggccgtttgggaagccaaggaaataaaggagaacctggagatctgggagaaaaaggagctgttggctttcctggtcctcgtggcttgcagggcaatgatggcagtccaggttatggtagtgtcggacgcaagggagcaaagggacaagaaggattccctggagaaagtggacctaagggtgagattggggaccctggtggtccaggagagactgggctgaagggagctagaggcaaaatgatatctgctgggcttccaggagagatgggatcccctggggaaccaggacctcctggacgtaagggtgtgaaaggagccaaaggcttggcttcattttctacatgtgagctcattcagtatgtgcgagaccgcagtcctggcaggcatgattgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgtgcaatcaacaaatatccaccaataaacttaaaaataaagtgcaacagacttaactctatagatccaaagcagcccccacgaccattccgaagctttgttcctggaccacttaaagctaccctcaaagaagatgtattacagaaggcaaaattctttcaagataaaaaatatctttcaagagtagcaagaagtggcagagatgatgctattcaaaattttatgagaagcacctcccatacctttaagaatggaaggatgatagaaagtgctcccaaacaacatgattaaaaaaatgcttgaacaacttagccttaggaagcatggtaagactctggacttaaatagtaactaaatctgctgccagaactcaagcaacagtttgtaggttatcaggtgacttgaccccctgcattcattggtattaagatatatcttgttcatttatttgaccactcctgacaattccagcactctacgactgatatgtcgaagaactgtttcattagaagacagaagaatgaaagaagtgttttgaaaagtctaatggagatataatttgaaggtaaaatttatatgatgtatgcatatgtgtacatgggtcaatgttaattcttttatctctgtccagttcattttctgcaaacccatcctcctttcctaatttagtaatgtctaatgctcatctatttagtcaaagttattttttaatgttttaagctactccaaaatttatcctagaaatggatgctgtttatatgtcgtatttttttaaaacgtgaccttctattccacttaaacacaccactgtgggagttgtttgcttggactgatgagaagagggtaattttctccatctctaaatcctcctgaactcactgaaaaactcattaattcccgcagaacataaattattgcttttgagctggaagttttctcttcattaggaagcttactgccattttgatggagcttgaagcccccattttgatggacttctagtctgtctttcctgttatggtcatttattaattttcactaatccatatattctttagacaaggagagtcaagaaactacttgtcatagatgaagctctgagttacttttacccatcaggtagctgtttagtcaataataaacagcaccaaaacaggattagcagagctcttaaaaacagccttaaatacacactgagtttagaaaaatgtaagaaaatcattgttttaatctacaaattcatatgcagttgcagagatgcaaaagagatcagagtaagttaaagtaggaaaggttttataaaagtattgatggctgtgtcctcatctgcatttttgtttttatgatagggctgatattttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaacaaata

SEQ ID NO: 121494 - DNA, 9276 bp, Homo sapiens
  Payload ID: 3825
  Gene Symbol: COL7A1
  Gene Name: collagen, type VII, alpha 1
  Uniprot ID: Q02388
  ENST ID: ENST00000328333
  CDS Start-End: 109-8943
gcaagaccaggactcgggctggaggggcgctgggctcggacctgccaaggccacgggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagcccaccagtgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccagctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacagggcctccctggcccctctggtccccctggattaccgggaaagccaggcgaggatggcaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 121495 - DNA, 597 bp, Homo sapiens
  Payload ID: 3825
  Gene Symbol: COL7A1
  Gene Name: collagen, type VII, alpha 1
  ENST ID: ENST00000422991
  CDS Start-End: 79-597
cctgctctacccgggagtggacgtgttggggttcccctctgagcgcccgtgtgtccgcactcacgtctgtggagccagatgtctgcactcgcgtgtgggctccctgtgcctgtgccatgcctgaactcccacctgtctatgggtcagaaaggggctccaggacccaaaggtttcaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggt

SEQ ID NO: 121496 - DNA, 5705 bp, Homo sapiens
  Payload ID: 3826
  Gene Symbol: COL8A1
  Gene Name: collagen, type VIII, alpha 1
  Uniprot ID: P27658
  ENST ID: ENST00000261037
  CDS Start-End: 381-2615
agagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcagtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaatttttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccatgagttaaggggatagatatagatggaaaaatacacaaataaatacggtatgaaaacacatggaaatgtgtctttgtcaaatctgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtatgtttctca

SEQ ID NO: 121497 - DNA, 3029 bp, Homo sapiens
  Payload ID: 3826
  Gene Symbol: COL8A1
  Gene Name: collagen, type VIII, alpha 1
  Uniprot ID: P27658
  ENST ID: ENST00000273342
  CDS Start-End: 198-2432
atcacagcccttccccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaac

SEQ ID NO: 121498 - DNA, 659 bp, Homo sapiens
  Payload ID: 3826
  Gene Symbol: COL8A1
  Gene Name: collagen, type VIII, alpha 1
  ENST ID: ENST00000452013
  CDS Start-End: 319-659
agagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagc

SEQ ID NO: 121499 - DNA, 948 bp, Homo sapiens
  Payload ID: 3826
  Gene Symbol: COL8A1
  Gene Name: collagen, type VIII, alpha 1
  ENST ID: ENST00000621757
  CDS Start-End: 342-948
gtgggagccagcgagcctctctccctgatcttacgtgctcaaggatccagtttcacctatggaatgagaaagttggggaagaagtcatctagcgtcttgctactcaaagtgtggtccatggaccagcagcatcagcatcacctgggatcttcttggaagaaatgtagaaactcaggcctcaccccagaatctgcctttttataagacccccagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatg

SEQ ID NO: 121500 - DNA, 4447 bp, Homo sapiens
  Payload ID: 3827
  Gene Symbol: COL8A2
  Gene Name: collagen, type VIII, alpha 2
  Uniprot ID: P25067
  ENST ID: ENST00000303143
  CDS Start-End: 8-2119
ggacgccatgctggggactctgacacccctgtcttcgctgctgctgctgctactggtgctggtgctggggtgtgggccgcgggcgtcctctggtggcggggccggtggggcggcgggctatgccccagtgaagtacatccagcccatgcagaaaggacctgtgggaccgcccttccgtgagggcaaaggccagtacctggaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaaggcagagcacctctcgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaa

SEQ ID NO: 121501 - DNA, 4670 bp, Homo sapiens
  Payload ID: 3827
  Gene Symbol: COL8A2
  Gene Name: collagen, type VIII, alpha 2
  Uniprot ID: P25067
  ENST ID: ENST00000397799
  CDS Start-End: 226-2337
tccggcagccgcgaggggcggccggcagagcgacgcggaaccccgccggcgcggaccccggaccccaacgccgcccgcccagccgcggacgcccctgcccggagccctcgccgcccgggccgccctcgagggccgggagcggcgcccggcggccgcgcccgcaggccctgcctctgctggaaccttcccaggcccctccgacctgaaagcacgtccacggacgccatgctggggactctgacacccctgtcttcgctgctgctgctgctactggtgctggtgctggggtgtgggccgcgggcgtcctctggtggcggggccggtggggcggcgggctatgccccagtgaagtacatccagcccatgcagaaaggacctgtgggaccgcccttccgtgagggcaaaggccagtacctggaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaaggcagagcacctctcgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacagca

SEQ ID NO: 121502 - DNA, 2036 bp, Homo sapiens
  Payload ID: 3827
  Gene Symbol: COL8A2
  Gene Name: collagen, type VIII, alpha 2
  ENST ID: ENST00000481785
  CDS Start-End: 58-1974
ggacgccatgctggggactctgacacccctgtcttcgctgctgctgctgctactgaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaa

SEQ ID NO: 121503 - DNA, 1353 bp, Homo sapiens
  Payload ID: 3827
  Gene Symbol: COL8A2
  Gene Name: collagen, type VIII, alpha 2
  ENST ID: ENST00000615990
  CDS Start-End: 8-1291
ggacgccatgctggggactctgacacccctgtcttcgctgctgctgctgctactggtgctggtgctggggtgtgggccgcgggcgtcctctggtggcggggccggtggggcggcgggctatgccccagtgaagtacatccagcccatgcagaaaggacctgtgggaccgcccttccgtgagggcaaaggccagtacctggaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaa

SEQ ID NO: 121504 - DNA, 3289 bp, Homo sapiens
  Payload ID: 3828
  Gene Symbol: COL10A1
  Gene Name: collagen, type X, alpha 1
  Uniprot ID: Q03692
  ENST ID: ENST00000243222
  CDS Start-End: 97-2139
caccttctgcactgctcatctgggcagaggaagcttcagaaagctgccaaggcaccatctccaggaactcccagcacgcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacacacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaatagatttttaggctgaattaatttgaaagcagcaatttgctgttctcaaccattctttcaaggcttttcattgttcaaagttaataaaaaagtaggacaataaagtg

SEQ ID NO: 121505 - DNA, 3498 bp, Homo sapiens
  Payload ID: 3828
  Gene Symbol: COL10A1
  Gene Name: collagen, type X, alpha 1
  Uniprot ID: Q03692
  ENST ID: ENST00000327673
  CDS Start-End: 409-2451
atcagtctgtggatgatagtcccaataaaaccatattgtaaaaatttgccctaatccgaatttcagtgtattttgaaactattagatatttcaggctatgtcaaagatcctagattatttaatacagacatccaatcctaatttctgtttcttttcctttaggtaaatcattttattttcacttgattacctgagtatagcttccaaaaataactaagacatatattcacataactaaaaaatgatctctcatttatttatggcacatattaaaaatatataggataggttaaaaaagtagataactgtataaagaactcatctgtgaaacatgagaataaaaaaataggttaataacaatgctgtataaagttattcttttctgtttttcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctcctggagtgggaaaaagaggtgaaaatggggttccaggacagccaggcatcaaaggtgatagaggttttccgggagaaatgggaccaattggcccaccaggtccccaaggccctcctggggaacgagggccagaaggcattggaaagccaggagctgctggagccccaggccagccagggattccaggaacaaaaggtctccctggggctccaggaatagctgggcccccagggcctcctggctttgggaaaccaggcttgccaggcctgaagggagaaagaggacctgctggccttcctgggggtccaggtgccaaaggggaacaagggccagcaggtcttcctgggaagccaggtctgactggaccccctgggaatatgggaccccaaggaccaaaaggcatcccgggtagccatggtctcccaggccctaaaggtgagacagggccagctgggcctgcaggataccctggggctaagggtgaaaggggttcccctgggtcagatggaaaaccagggtacccaggaaaaccaggtctcgatggtcctaagggtaacccagggttaccaggtccaaaaggtgatcctggagttggaggacctcctggtctcccaggccctgtgggcccagcaggagcaaagggaatgcccggacacaatggagaggctggcccaagaggtgcccctggaataccaggtactagaggccctattgggccaccaggcattccaggattccctgggtctaaaggggatccaggaagtcccggtcctcctggcccagctggcatagcaactaagggcctcaatggacccaccgggccaccagggcctccaggtccaagaggccactctggagagcctggtcttccagggccccctgggcctccaggcccaccaggtcaagcagtcatgcctgagggttttataaaggcaggccaaaggcccagtctttctgggacccctcttgttagtgccaaccagggggtaacaggaatgcctgtgtctgcttttactgttattctctccaaagcttacccagcaataggaactcccataccatttgataaaattttgtataacaggcaacagcattatgacccaaggactggaatctttacttgtcagataccaggaatatactatttttcataccacgtgcatgtgaaagggactcatgtttgggtaggcctgtataagaatggcacccctgtaatgtacacctatgatgaatacaccaaaggctacctggatcaggcttcagggagtgccatcatcgatctcacagaaaatgaccaggtgtggctccagcttcccaatgccgagtcaaatggcctatactcctctgagtatgtccactcctctttctcaggattcctagtggctccaatgtgagtacacacagagctaatctaaatcttgtgctagaaaaagcattctctaactctaccccaccctacaaaatgcatatggaggtaggctgaaaagaatgtaatttttattttctgaaatacagatttgagctatcagaccaacaaaccttccccctgaaaagtgagcagcaacgtaaaaacgtatgtgaagcctctcttgaatttctagttagcaatcttaaggctctttaaggttttctccaatattaaaaaatatcaccaaagaagtcctgctatgttaaaaacaaacaacaaaaaacaaacaacaaaaaaaaaattaaaaaaaaaaacagaaatagagctctaagttatgtgaaatttgatttgagaaactcggcatttcctttttaaaaaagcctgtttctaactatgaatatgagaacttctaggaaacatccaggaggtatcatataactttgtagaacttaaatacttgaatattcaaatttaaaagacactgtatcccctaaaatatttctgatggtgcactactctgaggcctgtatggcccctttcatcaatatctattcaaatatacaggtgcatatatacttgttaaagctcttatataaaaaagccccaaaatattgaagttcatctgaaatgcaaggtgctttcatcaatgaaccttttcaaacttttctatgattgcagagaagctttttatatacccagcataacttggaaacaggtatctgacctattcttatttagttaacacaagtgtgattaatttgatttctttaattccttattgaatcttatgtgatatgattttctggatttacagaacattagcacatgtaccttgtgcctcccattcaagtgaagttataatttacactgagggtttcaaaattcgactagaagtggagatatattatttatttatgcactgtactgtatttttatattgctgtttaaaacttttaagctgtgcctcacttattaaagcacaaaatgttttacctactccttatttacgacgcaataaaataacatcaataga

SEQ ID NO: 121506 - DNA, 303 bp, Homo sapiens
  Payload ID: 3828
  Gene Symbol: COL10A1
  Gene Name: collagen, type X, alpha 1
  ENST ID: ENST00000418500
  CDS Start-End: 150-303
gtttttacccctcctgggatcaccactgacagcatccatgaagttctgacagaagaacacaccaggatgacaaagtagtgacttttaaagagcagccaacaacaagcatatagggaatctctcagcaaatacagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaag

SEQ ID NO: 121507 - DNA, 732 bp, Homo sapiens
  Payload ID: 3828
  Gene Symbol: COL10A1
  Gene Name: collagen, type X, alpha 1
  ENST ID: ENST00000452729
  CDS Start-End: 84-732
gctcatctgggcagaggaagcttcagaaagctgccaaggcaccatctccaggaactcccagcacgcagaatccatctgagaatatgctgccacaaataccctttttgctgctagtatccttgaacttggttcatggagtgttttacgctgaacgataccaaatgcccacaggcataaaaggcccactacccaacaccaagacacagttcttcattccctacaccataaagagtaaaggtatagcagtaagaggagagcaaggtactcctggtccaccaggccctgctggacctcgagggcacccaggtccttctggaccaccaggaaaaccaggctacggaagtcctggactccaaggagagccagggttgccaggaccaccgggaccatcagctgtagggaaaccaggtgtgccaggactcccaggaaaaccaggagagagaggaccatatggaccaaaaggagatgttggaccagctggcctaccaggaccccggggcccaccaggaccacctggaatccctggaccggctggaatttctgtgccaggaaaacctggacaacagggacccacaggagccccaggacccaggggctttcctggagaaaagggtgcaccaggagtccctggtatgaatggacagaaaggggaaatgggatatggtgctcctggtcgtccaggtgagaggggtcttccaggccctcagggtcccacaggaccatctggccctc

SEQ ID NO: 121508 - DNA, 7173 bp, Homo sapiens
  Payload ID: 3829
  Gene Symbol: COL11A1
  Gene Name: collagen, type XI, alpha 1
  Uniprot ID: P12107
  ENST ID: ENST00000353414
  CDS Start-End: 319-5622
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgg

SEQ ID NO: 121509 - DNA, 7327 bp, Homo sapiens
  Payload ID: 3829
  Gene Symbol: COL11A1
  Gene Name: collagen, type XI, alpha 1
  Uniprot ID: P12107
  ENST ID: ENST00000358392
  CDS Start-End: 319-5775
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 121510 - DNA, 7286 bp, Homo sapiens
  Payload ID: 3829
  Gene Symbol: COL11A1
  Gene Name: collagen, type XI, alpha 1
  Uniprot ID: P12107
  ENST ID: ENST00000370096
  CDS Start-End: 314-5734
gtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 121511 - DNA, 1709 bp, Homo sapiens
  Payload ID: 3829
  Gene Symbol: COL11A1
  Gene Name: collagen, type XI, alpha 1
  ENST ID: ENST00000427239
  CDS Start-End: 1-1709
atggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatcc

SEQ ID NO: 121512 - DNA, 776 bp, Homo sapiens
  Payload ID: 3829
  Gene Symbol: COL11A1
  Gene Name: collagen, type XI, alpha 1
  ENST ID: ENST00000447608
  CDS Start-End: 1-603
tacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatcgcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataa

SEQ ID NO: 121513 - DNA, 5442 bp, Homo sapiens
  Payload ID: 3829
  Gene Symbol: COL11A1
  Gene Name: collagen, type XI, alpha 1
  Uniprot ID: P12107
  ENST ID: ENST00000512756
  CDS Start-End: 302-5374
tgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggagataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgcca

SEQ ID NO: 121514 - DNA, 5289 bp, Homo sapiens
  Payload ID: 3829
  Gene Symbol: COL11A1
  Gene Name: collagen, type XI, alpha 1
  ENST ID: ENST00000635193
  CDS Start-End: 1-2084
atcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaaggatttcagatgtcattggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatg

SEQ ID NO: 121515 - DNA, 6425 bp, Homo sapiens
  Payload ID: 3830
  Gene Symbol: COL11A2
  Gene Name: collagen, type XI, alpha 2
  ENST ID: ENST00000341947
  CDS Start-End: 229-5439
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121516 - DNA, 6104 bp, Homo sapiens
  Payload ID: 3830
  Gene Symbol: COL11A2
  Gene Name: collagen, type XI, alpha 2
  ENST ID: ENST00000361917
  CDS Start-End: 229-5118
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121517 - DNA, 6209 bp, Homo sapiens
  Payload ID: 3830
  Gene Symbol: COL11A2
  Gene Name: collagen, type XI, alpha 2
  ENST ID: ENST00000374708
  CDS Start-End: 260-5212
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggatgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121518 - DNA, 6209 bp, Homo sapiens
  Payload ID: 3830
  Gene Symbol: COL11A2
  Gene Name: collagen, type XI, alpha 2
  Uniprot ID: P13942
  ENST ID: ENST00000383087
  CDS Start-End: 260-5212
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121519 - DNA, 1194 bp, Homo sapiens
  Payload ID: 3830
  Gene Symbol: COL11A2
  Gene Name: collagen, type XI, alpha 2
  Uniprot ID: P13942
  ENST ID: ENST00000383088
  CDS Start-End: 215-1087
agccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 121520 - DNA, 6209 bp, Homo sapiens
  Payload ID: 3830
  Gene Symbol: COL11A2
  Gene Name: collagen, type XI, alpha 2
  ENST ID: ENST00000383219
  CDS Start-End: 260-5212
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121521 - DNA, 1194 bp, Homo sapiens; identical to SEQ ID NO: 121519
  Payload ID: 3830
  Gene Symbol: COL11A2
  Gene Name: collagen, type XI, alpha 2
  Uniprot ID: P13942
  ENST ID: ENST00000395194
  CDS Start-End: 215-1087

SEQ ID NO: 121522 - DNA, 1984 bp, Homo sapiens
  Payload ID: 3830
  Gene Symbol: COL11A2
  Gene Name: collagen, type XI, alpha 2
  ENST ID: ENST00000433947
  CDS Start-End: 1-1001
aaaaccaaagcccacaagcccacagatccacagtcccacacactgcaggcctgggccagctgtgtttgcttgggtttgggatggattggagggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctccc

SEQ ID NO: 121523 - DNA, 6209 bp, Homo sapiens
  Payload ID: 3830
  Gene Symbol: COL11A2
  Gene Name: collagen, type XI, alpha 2
  ENST ID: ENST00000447349
  CDS Start-End: 260-5212
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121524 - DNA, 2099 bp, Homo sapiens
  Payload ID: 3830
  Gene Symbol: COL11A2
  Gene Name: collagen, type XI, alpha 2
  ENST ID: ENST00000452730
  CDS Start-End: 228-2099
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 121525 - DNA, 2099 bp, Homo sapiens; identical to SEQ ID NO: 121524
  Payload ID: 3830
  Gene Symbol: COL11A2
  Gene Name: collagen, type XI, alpha 2
  ENST ID: ENST00000420405
  CDS Start-End: 228-2099

SEQ ID NO: 121526 - DNA, 1194 bp, Homo sapiens
  Payload ID: 3830
  Gene Symbol: COL11A2
  Gene Name: collagen, type XI, alpha 2
  ENST ID: ENST00000435763
  CDS Start-End: 215-1087
agccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 121527 - DNA, 2099 bp, Homo sapiens
  Payload ID: 3830
  Gene Symbol: COL11A2
  Gene Name: collagen, type XI, alpha 2
  ENST ID: ENST00000451040
  CDS Start-End: 228-2099
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 121528 - DNA, 2099 bp, Homo sapiens; identical to SEQ ID NO: 121527
  Payload ID: 3830
  Gene Symbol: COL11A2
  Gene Name: collagen, type XI, alpha 2
  ENST ID: ENST00000438711
  CDS Start-End: 228-2099

SEQ ID NO: 121529 - DNA, 1194 bp, Homo sapiens; identical to SEQ ID NO: 121519
  Payload ID: 3830
  Gene Symbol: COL11A2
  Gene Name: collagen, type XI, alpha 2
  Uniprot ID: P13942
  ENST ID: ENST00000447741
  CDS Start-End: 215-1087

SEQ ID NO: 121530 - DNA, 1984 bp, Homo sapiens; identical to SEQ ID NO: 121522
  Payload ID: 3830
  Gene Symbol: COL11A2
  Gene Name: collagen, type XI, alpha 2
  ENST ID: ENST00000443125
  CDS Start-End: 1-1001

SEQ ID NO: 121531 - DNA, 5868 bp, Homo sapiens
  Payload ID: 3830
  Gene Symbol: COL11A2
  Gene Name: collagen, type XI, alpha 2
  ENST ID: ENST00000443138
  CDS Start-End: 1-4871
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121532 - DNA, 2099 bp, Homo sapiens; identical to SEQ ID NO: 121527
  Payload ID: 3830
  Gene Symbol: COL11A2
  Gene Name: collagen, type XI, alpha 2
  ENST ID: ENST00000457788
  CDS Start-End: 228-2099

SEQ ID NO: 121533 - DNA, 1194 bp, Homo sapiens; identical to SEQ ID NO: 121519
  Payload ID: 3830
  Gene Symbol: COL11A2
  Gene Name: collagen, type XI, alpha 2
  Uniprot ID: P13942
  ENST ID: ENST00000452937
  CDS Start-End: 215-1087

SEQ ID NO: 121534 - DNA, 6209 bp, Homo sapiens
  Payload ID: 3830
  Gene Symbol: COL11A2
  Gene Name: collagen, type XI, alpha 2
  ENST ID: ENST00000425729
  CDS Start-End: 260-5212
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 121535 - DNA, 898 bp, Homo sapiens
  Payload ID: 3830
  Gene Symbol: COL11A2
  Gene Name: collagen, type XI, alpha 2
  ENST ID: ENST00000434780
  CDS Start-End: 1-791
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaa

SEQ ID NO: 121536 - DNA, 6209 bp, Homo sapiens; identical to SEQ ID NO: 121517
  Payload ID: 3830
  Gene Symbol: COL11A2
  Gene Name: collagen, type XI, alpha 2
  ENST ID: ENST00000448717
  CDS Start-End: 260-5212

SEQ ID NO: 121537 - DNA, 1194 bp, Homo sapiens; identical to SEQ ID NO: 121519
  Payload ID: 3830
  Gene Symbol: COL11A2
  Gene Name: collagen, type XI, alpha 2
  Uniprot ID: P13942
  ENST ID: ENST00000439039
  CDS Start-End: 215-1087

SEQ ID NO: 121538 - DNA, 1790 bp, Homo sapiens
  Payload ID: 3830
  Gene Symbol: COL11A2
  Gene Name: collagen, type XI, alpha 2
  ENST ID: ENST00000447855
  CDS Start-End: 1-1790
gtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 121539 - DNA, 2099 bp, Homo sapiens
  Payload ID: 3830
  Gene Symbol: COL11A2
  Gene Name: collagen, type XI, alpha 2
  ENST ID: ENST00000452044
  CDS Start-End: 228-2099
acacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccct

SEQ ID NO: 121540 - DNA, 6104 bp, Homo sapiens
  Payload ID: 3830
  Gene Symbol: COL11A2
  Gene Name: collagen, type XI, alpha 2
  ENST ID: ENST00000552473
  CDS Start-End: 229-5118
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121541 - DNA, 6425 bp, Homo sapiens; identical to SEQ ID NO: 121515
  Payload ID: 3830
  Gene Symbol: COL11A2
  Gene Name: collagen, type XI, alpha 2
  ENST ID: ENST00000551758
  CDS Start-End: 229-5439

SEQ ID NO: 121542 - DNA, 6104 bp, Homo sapiens
  Payload ID: 3830
  Gene Symbol: COL11A2
  Gene Name: collagen, type XI, alpha 2
  Uniprot ID: P13942
  ENST ID: ENST00000551542
  CDS Start-End: 229-5118
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121543 - DNA, 6425 bp, Homo sapiens
  Payload ID: 3830
  Gene Symbol: COL11A2
  Gene Name: collagen, type XI, alpha 2
  ENST ID: ENST00000549836
  CDS Start-End: 229-5439
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121544 - DNA, 6425 bp, Homo sapiens
  Payload ID: 3830
  Gene Symbol: COL11A2
  Gene Name: collagen, type XI, alpha 2
  ENST ID: ENST00000551413
  CDS Start-End: 229-5439
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121545 - DNA, 6425 bp, Homo sapiens
  Payload ID: 3830
  Gene Symbol: COL11A2
  Gene Name: collagen, type XI, alpha 2
  ENST ID: ENST00000549885
  CDS Start-End: 229-5439
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacaagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121546 - DNA, 6425 bp, Homo sapiens
  Payload ID: 3830
  Gene Symbol: COL11A2
  Gene Name: collagen, type XI, alpha 2
  Uniprot ID: P13942
  ENST ID: ENST00000549811
  CDS Start-End: 229-5439
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccagcccactgagtctctctactatgactacgagcccccctattatgatgtgatgactacggggacaacccctgattatcaggaccccaccccaggtgaagaggaagaaatcctggagtcgagcctcttgccaccccttgaggaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggtcctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccctgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcccggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121547 - DNA, 6104 bp, Homo sapiens
  Payload ID: 3830
  Gene Symbol: COL11A2
  Gene Name: collagen, type XI, alpha 2
  ENST ID: ENST00000552134
  CDS Start-End: 229-5118
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggcccacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121548 - DNA, 6104 bp, Homo sapiens; identical to SEQ ID NO: 121516
  Payload ID: 3830
  Gene Symbol: COL11A2
  Gene Name: collagen, type XI, alpha 2
  ENST ID: ENST00000550998
  CDS Start-End: 229-5118

SEQ ID NO: 121549 - DNA, 6104 bp, Homo sapiens
  Payload ID: 3830
  Gene Symbol: COL11A2
  Gene Name: collagen, type XI, alpha 2
  ENST ID: ENST00000549491
  CDS Start-End: 229-5118
cacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggctgcccatggaccccgagggctgaagggagagaaaggagagcctgcagtgttggaacctggtatgctcgtggaggggccccctggcccagaaggccctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggccctcctggcaaggctgggcgaaggggccgggcaggtgctgatggagcccgagggatgcctggagatcctggagtgaagggtgaccgaggttttgatggactcccagggctccctggagagaagggccataggggtgatactggtgcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggtgccatcggccctcatggagagaagggtcctcaagggaagccagggctccccggcatgcctggctcagacggacccccgggtcacccagggaaggaaggtccccctggaaccaaaggaaaccagggtccctctggacctcagggacctctaggatacccaggacctcgaggggtcaagggtgtggacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacggggtcagcggggaccccgaggtgccactgggaagtctggagctaagggaacatctggtggtgatggcccccatgggccccctggagagaggggcctccctggacctcagggtcccaacgggtttcctggaccgaaaggacccccgggcccccctgggaaggacgggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtccgccagggcgcccaggcccgcagggtccccctggagcagcaggagagaaaggtgtcccaggtgagaagggccccattggcccaactggccgagatggagtgcagggtcctgtggggcttcctggtcctgctgggcctccaggtgtggctggagaggatggagacaagggtgaggtgggggaccccggacagaagggcaccaaagggaacaagggtgaacatggccctcctggaccccctggacccattggtcctgtggggcagcctggagcagcgggagcagatggggagcctggagctcggggaccccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccagg

SEQ ID NO: 121550 - DNA, 5886 bp, Homo sapiens
  Payload ID: 3831
  Gene Symbol: COL12A1
  Gene Name: collagen, type XII, alpha 1
  Uniprot ID: Q99715
  ENST ID: ENST00000345356
  CDS Start-End: 111-5810
caccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtg

SEQ ID NO: 121551 - DNA, 11723 bp, Homo sapiens
  Payload ID: 3831
  Gene Symbol: COL12A1
  Gene Name: collagen, type XII, alpha 1
  Uniprot ID: Q99715
  ENST ID: ENST00000322507
  CDS Start-End: 311-9502
acttggctaaggcgaaccgccccagacgcgtccgcgcgccggcagctgcaggctcaggccatctccagtcttcctgccgcgcccgcctctcctcctgggattctcctcctcctcctggacttccccgcagctgcccacgcctcggcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgccttccaaatcatgccataattgtaatgttgaatcggacagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 121552 - DNA, 1914 bp, Homo sapiens
  Payload ID: 3831
  Gene Symbol: COL12A1
  Gene Name: collagen, type XII, alpha 1
  ENST ID: ENST00000419671
  CDS Start-End: 1-1914
gaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacacctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgca

SEQ ID NO: 121553 - DNA, 3135 bp, Homo sapiens
  Payload ID: 3831
  Gene Symbol: COL12A1
  Gene Name: collagen, type XII, alpha 1
  ENST ID: ENST00000425443
  CDS Start-End: 1-2271
gtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 121554 - DNA, 8964 bp, Homo sapiens
  Payload ID: 3831
  Gene Symbol: COL12A1
  Gene Name: collagen, type XII, alpha 1
  Uniprot ID: Q99715
  ENST ID: ENST00000416123
  CDS Start-End: 1-8964
atgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaagagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaa

SEQ ID NO: 121555 - DNA, 9637 bp, Homo sapiens
  Payload ID: 3831
  Gene Symbol: COL12A1
  Gene Name: collagen, type XII, alpha 1
  ENST ID: ENST00000483888
  CDS Start-End: 82-9270
aagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccaggcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggtacgttgttgccattgtaggaaccccaactcacctgaagtaaagaactttacggaaatgaagttccttaggattgaaggaaggctgatttgaagatgtcttgaagataacaactctttcagttctgattatataataatagtgtttgctatcatagcacacaacattatttcactgttaggattgaattattttcttttttccccatgtttctgcatttaccaaatcacatcataaacctccccttacttctcttgggacttcaaagcatgctagtaattgactttttttttttcttttccccaagattgggaacagggatttgttaaatacaactgtaaaatgccaagaatatgtatttaaaaattgttttgggaatctaattta

SEQ ID NO: 121556 - DNA, 794 bp, Homo sapiens
  Payload ID: 3831
  Gene Symbol: COL12A1
  Gene Name: collagen, type XII, alpha 1
  ENST ID: ENST00000493109
  CDS Start-End: 1-624
gtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggtaaaaacataagattatttgagtcttatttctagaaaaaaatataaaacaaatttattatttattaaaatgtcatgttaaattggcagaattataactatgtcttttaaaaataaaatcttgttttagagaatttggttaattcaaataatatttaaaataaaacaatatactaatcaaga

SEQ ID NO: 121557 - DNA, 11579 bp, Homo sapiens
  Payload ID: 3831
  Gene Symbol: COL12A1
  Gene Name: collagen, type XII, alpha 1
  ENST ID: ENST00000615798
  CDS Start-End: 3734-9358
gcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcattcacggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgccttccaaatcatgccataattgtaatgttgaatcggacagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 121558 - DNA, 3027 bp, Homo sapiens
  Payload ID: 3832
  Gene Symbol: COL13A1
  Gene Name: collagen, type XIII, alpha 1
  Uniprot ID: Q5TAT6
  ENST ID: ENST00000354547
  CDS Start-End: 493-2580
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 121559 - DNA, 2991 bp, Homo sapiens
  Payload ID: 3832
  Gene Symbol: COL13A1
  Gene Name: collagen, type XIII, alpha 1
  Uniprot ID: Q5TAT6
  ENST ID: ENST00000357811
  CDS Start-End: 493-2544
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 121560 - DNA, 2267 bp, Homo sapiens
  Payload ID: 3832
  Gene Symbol: COL13A1
  Gene Name: collagen, type XIII, alpha 1
  ENST ID: ENST00000398969
  CDS Start-End: 307-2235
ggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtg

SEQ ID NO: 121561 - DNA, 1057 bp, Homo sapiens
  Payload ID: 3832
  Gene Symbol: COL13A1
  Gene Name: collagen, type XIII, alpha 1
  ENST ID: ENST00000398975
  CDS Start-End: 1-743
agatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactg

SEQ ID NO: 121562 - DNA, 3093 bp, Homo sapiens
  Payload ID: 3832
  Gene Symbol: COL13A1
  Gene Name: collagen, type XIII, alpha 1
  Uniprot ID: Q5TAT6
  ENST ID: ENST00000398978
  CDS Start-End: 493-2646
gtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatggcaattca

SEQ ID NO: 121563 - DNA, 749 bp, Homo sapiens
  Payload ID: 3832
  Gene Symbol: COL13A1
  Gene Name: collagen, type XIII, alpha 1
  ENST ID: ENST00000456019
  CDS Start-End: 1-523
aggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaa

SEQ ID NO: 121564 - DNA, 2276 bp, Homo sapiens
  Payload ID: 3832
  Gene Symbol: COL13A1
  Gene Name: collagen, type XIII, alpha 1
  Uniprot ID: Q5TAT6
  ENST ID: ENST00000520267
  CDS Start-End: 307-2244
ggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtg

SEQ ID NO: 121565 - DNA, 2061 bp, Homo sapiens
  Payload ID: 3832
  Gene Symbol: COL13A1
  Gene Name: collagen, type XIII, alpha 1
  Uniprot ID: Q5TAT6
  ENST ID: ENST00000522165
  CDS Start-End: 1-2061
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtga

SEQ ID NO: 121566 - DNA, 2007 bp, Homo sapiens
  Payload ID: 3832
  Gene Symbol: COL13A1
  Gene Name: collagen, type XIII, alpha 1
  Uniprot ID: Q5TAT6
  ENST ID: ENST00000517713
  CDS Start-End: 1-2007
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtga

SEQ ID NO: 121567 - DNA, 2934 bp, Homo sapiens
  Payload ID: 3832
  Gene Symbol: COL13A1
  Gene Name: collagen, type XIII, alpha 1
  ENST ID: ENST00000479733
  CDS Start-End: 494-2242
tgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtgggagtaaagggccaaccaggcgagaaggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggtctagatggcccaactggggagaggagaacatggtggccagagcagacccagagtggcaggattgcctaatccagctgggctcctgaggtttacaggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtc

SEQ ID NO: 121568 - DNA, 1833 bp, Homo sapiens
  Payload ID: 3832
  Gene Symbol: COL13A1
  Gene Name: collagen, type XIII, alpha 1
  Uniprot ID: Q5TAT6
  ENST ID: ENST00000520133
  CDS Start-End: 1-1833
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggcgaagatggcttaccagtccaaggctgctggaacaagtga

SEQ ID NO: 121569 - DNA, 3450 bp, Homo sapiens
  Payload ID: 3833
  Gene Symbol: COL14A1
  Gene Name: collagen, type XIV, alpha 1
  ENST ID: ENST00000247781
  CDS Start-End: 381-2654
gacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaacttt

SEQ ID NO: 121570 - DNA, 6466 bp, Homo sapiens
  Payload ID: 3833
  Gene Symbol: COL14A1
  Gene Name: collagen, type XIV, alpha 1
  Uniprot ID: Q05707
  ENST ID: ENST00000297848
  CDS Start-End: 271-5661
atctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaactttaaaacaatg

SEQ ID NO: 121571 - DNA, 6163 bp, Homo sapiens
  Payload ID: 3833
  Gene Symbol: COL14A1
  Gene Name: collagen, type XIV, alpha 1
  Uniprot ID: Q05707
  ENST ID: ENST00000309791
  CDS Start-End: 271-5613
atctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctcttccctggtgatggacttctaacatgagattttttaaaaaaatttctatttcttttataattttgctgagttttcagggtttcttctgtaaataaaacataatatttaaa

SEQ ID NO: 121572 - DNA, 697 bp, Homo sapiens
  Payload ID: 3833
  Gene Symbol: COL14A1
  Gene Name: collagen, type XIV, alpha 1
  ENST ID: ENST00000440844
  CDS Start-End: 1-450
gggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagaggatggatgggcatctttctccttgaccaccctactctcccttcctcccctgatcacctcccctccctgctcttccctggtgatggacttctaacatgagattttttaaaaaaatttctatttcttttataattttgctgagttttcagggtttcttctgtaaataaaacataatatttaaatggttggttatgattctagttttctaacaatttctgtaatgtatctttcccttcgtctatttactaactgtctgaaaccttatggggaaggtacaaggggcgtggtggattaagacatccactgctttttacccagcaggatatctctgtgtctctaaggaccc

SEQ ID NO: 121573 - DNA, 2621 bp, Homo sapiens
  Payload ID: 3833
  Gene Symbol: COL14A1
  Gene Name: collagen, type XIV, alpha 1
  ENST ID: ENST00000434620
  CDS Start-End: 1-2532
ttcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaaggtaaaagaataatagaataattatctgattctaggtttaggatttgtgttggttttgtttgcctgttcatttcaaaccaggatattaataaagtatatttattgtgcta

SEQ ID NO: 121574 - DNA, 3244 bp, Homo sapiens
  Payload ID: 3833
  Gene Symbol: COL14A1
  Gene Name: collagen, type XIV, alpha 1
  ENST ID: ENST00000498051
  CDS Start-End: 297-1901
cttctccctcctgccgccttatgaacagggtgactgtttccccatcggccatgattttaagtttcctgaggcctccccagtcatgctgaactatactgttcctaagagcatctgccccagtcaacttctcatccacagatattaatctcagtcaacctccagatttttagacatattttgaaagtctttcatcaccagatttcaaaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacatcaccttaattattaagagattcactaactcctacaagatctttattgtcaaagaatcagtatgtattgaattaatgaaagaactgggctttgaggttaggaaacatcatgcttcgtggctatggctgtggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggtctgtataaattcaactgactagaaactctgcagatgttactaacacagctaataagactgtcttcggagatcaatgcaaactttactgctcttttctcagtgactctgccatctccagaaactaatgttctctgttaatctgactccactactggcttcttagtgacctttataaatccaaaacttgctccatgtacaacttgctccaagttaataacctctgaacattgtttcaaatattgcttctcttctgctgccttgcacctgttcgagcaccaaagttgggtcataaaaggccatatgcacttgtgtctgtatatatgtatgtatagacatgtataaaagtttaatatagaaaataatttcttctgcccttggaaatctgataaaaaaacttttaagcaaaggacacagaaaaggtcttctatatggtatagtgaaaatattcttaataaaataccatccgttaa

SEQ ID NO: 121575 - DNA, 1008 bp, Homo sapiens
  Payload ID: 3833
  Gene Symbol: COL14A1
  Gene Name: collagen, type XIV, alpha 1
  ENST ID: ENST00000523142
  CDS Start-End: 1-1008
tgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggt

SEQ ID NO: 121576 - DNA, 3119 bp, Homo sapiens
  Payload ID: 3833
  Gene Symbol: COL14A1
  Gene Name: collagen, type XIV, alpha 1
  ENST ID: ENST00000537875
  CDS Start-End: 175-1779
aacatcaaatacatttaatttaaaatgaattaaaattatcatatagatatctatttctatcatttttcttcccttcttttcacaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacatcaccttaattattaagagattcactaactcctacaagatctttattgtcaaagaatcagtatgtattgaattaatgaaagaactgggctttgaggttaggaaacatcatgcttcgtggctatggctgtggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggtctgtataaattcaactgactagaaactctgcagatgttactaacacagctaataagactgtcttcggagatcaatgcaaactttactgctcttttctcagtgactctgccatctccagaaactaatgttctctgttaatctgactccactactggcttcttagtgacctttataaatccaaaacttgctccatgtacaacttgctccaagttaataacctctgaacattgtttcaaatattgcttctcttctgctgccttgcacctgttcgagcaccaaagttgggtcataaaaggccatatgcacttgtgtctgtatatatgtatgtatagacatgtataaaagtttaatatagaaaataatttcttctgcccttggaaatctgataaaaaaacttttaagcaaaggacacagaaaaggtcttctatatggtatagtgaaaatattcttaataaaataccatccgt

SEQ ID NO: 121577 - DNA, 256 bp, Homo sapiens
  Payload ID: 3834
  Gene Symbol: COL19A1
  Gene Name: collagen, type XIX, alpha 1
  ENST ID: ENST00000455415
  CDS Start-End: 1-111
ggacctcctggaatacaaggaatacaccaaactcttggtggatattataacaaggataacaagggaaatgatgaacatgaagctggaggcctgaaaggagacaaggtttaattatcatagctgtaaagatgacagattcacttccccattcaataagatgtttcactcctgtttgattctgaaattgtaatgaccttggattccatgtgaatgtgccattgtcagaaaaaaaatgcacattaaatctacaggcaga

SEQ ID NO: 121578 - DNA, 589 bp, Homo sapiens
  Payload ID: 3834
  Gene Symbol: COL19A1
  Gene Name: collagen, type XIX, alpha 1
  ENST ID: ENST00000478620
  CDS Start-End: 255-437
agtcgcggcgcgaggaagacgcggccccagcctctgccgcctccgctgtcagagtcccgaggccaccgccgagagcgcgccggcgccgcagccacagcggccgagaaccaggaggcggcgccgggcggcccagctagggcgctgcagggtcgcgaggaagtttgttggcccggaaccaagcacgccgtcgggcacgctagctccccgagagcaggcgggcgcatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattgaaaaggccatagattaatgtactataacagaataaattacaattcattgctttcttccattgatcttcccatgatgcacattaggaattcctaaaattacctcatttttttcatacgcatagtatattagtctatgtttcctttcatcttcaatatttacaagt

SEQ ID NO: 121579 - DNA, 6233 bp, Homo sapiens
  Payload ID: 3834
  Gene Symbol: COL19A1
  Gene Name: collagen, type XIX, alpha 1
  Uniprot ID: Q14993
  ENST ID: ENST00000620364
  CDS Start-End: 103-3531
actcctcggcggtgccgcagccctgtccggactccactgcgcctctgaggggctcaaatacgaattcaagatccgtggccgttcacatggtttcaaggcacaatgagactcactggcccttggaaactttggctttggatgtcaatatttctgcttcctgcttccacttccgtgaccgttagggacaagacagaagagtcatgccctatcctgagaatagagggacatcagctgacatatgacaacataaacaaacttgaagtttcaggttttgatctaggagacagcttttctctaagacgtgcattttgtgaaagtgataaaacctgtttcaaattgggaagtgcacttcttattagagacactattaagatatttcccaaaggccttcctgaggagtactcagtagctgccatgtttcgagtacgaagaaacgccaaaaaggaacggtggtttctgtggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaagggtgaaactggactaccaggatttccagggtctgttggccctaaaggacaaaaaggagaacctggagagccttttacaaaaggagaaaaaggagatagaggagaacctggggtaataggatcacagggagtaaagggtgaacctggagatcccggaccccctggtttaataggaagcccaggactaaagggtcagcaaggatctgcaggctccatgggacccagaggaccgccaggagatgttggattgccaggagaacatggtatcccaggaaaacaaggcattaaaggagaaaagggagatccgggtgggatcataggccctcccgggcttccaggtccaaaaggtgaggctggtcctccagggaaaagcctgccaggggaaccaggattagatggaaatcctggagcacctggtccacgtgggccaaagggtgaaagaggacttccaggtgttcacggttccccaggggacataggcccacaagggataggaattcctggcagaacaggcgcccaaggaccagctggagagccaggtattcagggtcctcgaggtctccctgggttgccaggaactccagggactccagggaatgatggagttccagggagagatggaaagccaggcctgccaggccccccaggtgacccgattgcacttcctctcttgggagacatcggtgctttgctcaagaatttctgtggcaactgccaagccagtgtcccagggctgaaaagcaacaaaggagaagaaggaggtgctggtgagcctggaaagtatgattccatggcccggaagggtgatatagggccacggggtcctccaggaatcccaggaagagagggaccaaagggaagcaaaggagagcggggctaccctgggatacctggggagaaaggcgatgagggtcttcaaggaattccaggcattccaggtgctccaggcccgactggaccccctggcttaatgggaagaactggacatcctggtcccacaggagcaaaaggtgaaaagggcagcgacggaccccctgggaaacccggaccacctggaccacctggtattccatttaatgaacgaaacggcatgagcagtttatataaaattaagggaggtgtgaatgttcccagttacccagggccacccggtcctcctggcccaaaaggcgatcctggcccagtgggagagcctggtgcaatggggttgccaggattagaaggatttccaggtgtaaagggagatcgaggcccagcaggtcccccaggaatagcagggatgtcgggaaaacctggtgccccagggcctccaggagttccaggggaaccgggtgagagaggacctgttggagatataggtttccctggaccagaaggaccctcaggaaagccaggaataaatggaaaagatggaataccaggtgctcagggcatcatgggtaagcctggagacagaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaaggctacagaggacagaagggagaaagaggtgaacctggaattgggctgccagggagtccaggtcttcctgggacttcagctctgggtttgccaggctcaccaggtgccccaggcccacagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttatgttttcaaaaaaaaaatgcaggaaactgttttatcagggagcccaaacacccagcatagccaactactgaaatgattttgttaattctgtataatgagctcaattcaaagcaatcaccactggcatgaataagtactgcatgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttattttatttattgtaagcattttgacattgattttttttttttcgttttctttcttgtgcaatacctacaatggtgctgtgttttaaacttacacaattgggacatacgtatgtgttttcttagtaaaatggtaatttatcccgaaaaagtgtacatagatctaaaatttggtgctatgtgtatatcttgagcttttaatttgttgaattttctaaacgcttacaacttatctgccactcatattaatttacttgaatttgtcataaagctaaatattttatatgttttcaaagattattttttcatattaataggttgtttatctttttgcctgtttgctaatttaaaaatatttattttatcattttaatgttttcatggacttttttgctgatggtaatcaactttttttgttttttggtttttgagttgttcttgtcatagacataaaaagacaattcattttcttgttttattaactctgttcatttttattctacaaaatatgtcatgcattctttcttatgaattgtatatttagaaatctttctaaataccattaaggcttgactggttaattcctatttcaaggatttggatttattcaggtaatttgatgggatggggaaatataatattgtgtgatgcatattacaaagtggacttgtcacaatgacacaaactcattttttgtaactgggaaatatgactaaatttgacgtaactagagaaacaaggctgtatccacatggtacaagcctttctcaccctactctattatttaccttcagatactttttcctgcctcagctctgtacacatgatatgcaacaaagggcagcaagaaatgctgggtccacctaatttaacacaaaatgaagttgagattcggcagttgcccaattcctttaataaaaagaaactaaataatttgggccccaaagtagggtgggaagttttcctctaaatgac

SEQ ID NO: 121580 - DNA, 5496 bp, Homo sapiens
  Payload ID: 3835
  Gene Symbol: COL15A1
  Gene Name: collagen, type XV, alpha 1
  Uniprot ID: P39059
  ENST ID: ENST00000375001
  CDS Start-End: 424-4590
acaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttga

SEQ ID NO: 121581 - DNA, 5422 bp, Homo sapiens
  Payload ID: 3835
  Gene Symbol: COL15A1
  Gene Name: collagen, type XV, alpha 1
  ENST ID: ENST00000610452
  CDS Start-End: 392-4516
aggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaaggcaaaggggccatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttcatttga

SEQ ID NO: 121582 - DNA, 924 bp, Homo sapiens
  Payload ID: 3836
  Gene Symbol: COL16A1
  Gene Name: collagen, type XVI, alpha 1
  ENST ID: ENST00000373667
  CDS Start-End: 1-924
aaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatggagggaaaggtgagcggggcctgcctggtccaccaggctccaagggagagaagggagcacggggcaatgactgtgttcgaatctccccggatgccccacttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccg

SEQ ID NO: 121583 - DNA, 3643 bp, Homo sapiens
  Payload ID: 3836
  Gene Symbol: COL16A1
  Gene Name: collagen, type XVI, alpha 1
  ENST ID: ENST00000373668
  CDS Start-End: 518-3418
cctgactcttaaagggcccgcaggagcccccttccagggcagctctgggcacgtagggtcccgcctagctcgaggatcgctcacctggcggtgaggcaggaggggcgggcctgggagctcggccagacccggggcggggctgtgcaccccgcagtctagccgcctctggtgccgctggagccccctctaggccctcctcctcctcctccctggcgggccggtccagctgtgttccattagtgtccctggcaggcccccagccccctggaaccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagacgtctgccatcaagaagatccgcaaccccaaggggcctctcatcctgcgcctgggggcggcccccgtgacccagcccacgcgaagagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccacttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtccaccaggtattcccggaccaccaggcccccctggagtacctgggctgcaggtaaagggggagaagagaatgaggagcttgggtggcagagctcatgggtcaggatggctgctcccggctggaccccaaggatgctgctcccccaccccaaaaacacagacatgccatttctcactcctctgtttacctgcctcccagggtggcaaggagggcccactgagcctctaggccaggctctgcactcccagcactgtttcaagcaatgcactgttgcgtcagctgtcaggcacccacaatctgggtcagataaaaatcccttaccctggtacagagcccggcccactgttttggagtagcattcaacactcattcatgcaacatgtgtttttgcacatttgctattttctggcactgctttaactgctgtgaatacagtagtggctaaaaataaaa

SEQ ID NO: 121584 - DNA, 5736 bp, Homo sapiens
  Payload ID: 3836
  Gene Symbol: COL16A1
  Gene Name: collagen, type XVI, alpha 1
  Uniprot ID: Q07092
  ENST ID: ENST00000373672
  CDS Start-End: 518-5332
cctgactcttaaagggcccgcaggagcccccttccagggcagctctgggcacgtagggtcccgcctagctcgaggatcgctcacctggcggtgaggcaggaggggcgggcctgggagctcggccagacccggggcggggctgtgcaccccgcagtctagccgcctctggtgccgctggagccccctctaggccctcctcctcctcctccctggcgggccggtccagctgtgttccattagtgtccctggcaggcccccagccccctggaaccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagacgtctgccatcaagaagatccgcaaccccaaggggcctctcatcctgcgcctgggggcggcccccgtgacccagcccacgcgaagagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccacttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 121585 - DNA, 672 bp, Homo sapiens
  Payload ID: 3836
  Gene Symbol: COL16A1
  Gene Name: collagen, type XVI, alpha 1
  ENST ID: ENST00000440437
  CDS Start-End: 1-672
ggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaag

SEQ ID NO: 121586 - DNA, 706 bp, Homo sapiens
  Payload ID: 3836
  Gene Symbol: COL16A1
  Gene Name: collagen, type XVI, alpha 1
  ENST ID: ENST00000458715
  CDS Start-End: 1-706
ggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggcc

SEQ ID NO: 121587 - DNA, 5734 bp, Homo sapiens
  Payload ID: 3837
  Gene Symbol: COL17A1
  Gene Name: collagen, type XVII, alpha 1
  Uniprot ID: Q9UMD9
  ENST ID: ENST00000353479
  CDS Start-End: 292-4785
aaatccagcaagtgtcagataattggaagggtggagtaacgctgtaaaccatgacacacctttgtcaggacatgtttggaagcaaagagttgaaagaaacaaggtggagagaaagaaaagtgaacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaata

SEQ ID NO: 121588 - DNA, 5488 bp, Homo sapiens
  Payload ID: 3837
  Gene Symbol: COL17A1
  Gene Name: collagen, type XVII, alpha 1
  Uniprot ID: Q9UMD9
  ENST ID: ENST00000369733
  CDS Start-End: 292-4539
aaatccagcaagtgtcagataattggaagggtggagtaacgctgtaaaccatgacacacctttgtcaggacatgtttggaagcaaagagttgaaagaaacaaggtggagagaaagaaaagtgaacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagctgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaata

SEQ ID NO: 121589 - DNA, 1610 bp, Homo sapiens
  Payload ID: 3837
  Gene Symbol: COL17A1
  Gene Name: collagen, type XVII, alpha 1
  ENST ID: ENST00000393211
  CDS Start-End: 68-1321
agagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggtaagaacaaatatgattgttgtccaccttgacttcagccaggccacatttcatttcattgtcttcggagaccttgctactcaaagtgtggtccacgggccagcagcatcagccacacctgggagtgtgttataaaagcaggatcccagccctagctcagatctgctgagtcagaagctgcagttcaacaagcttcctaggtgatttgcatttgcattactgaagcaaaagcctgcctctgccatgtctacgaaggcatttgttttctcattttactttttctccataatcttcagaactaatagaaaaatgctttgcaaa

SEQ ID NO: 121590 - DNA, 537 bp, Homo sapiens
  Payload ID: 3837
  Gene Symbol: COL17A1
  Gene Name: collagen, type XVII, alpha 1
  ENST ID: ENST00000433822
  CDS Start-End: 1-200
cttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 121591 - DNA, 3386 bp, Homo sapiens
  Payload ID: 3838
  Gene Symbol: COL18A1
  Gene Name: collagen, type XVIII, alpha 1
  ENST ID: ENST00000342220
  CDS Start-End: 1-2064
ggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcagggcaggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 121592 - DNA, 5924 bp, Homo sapiens
  Payload ID: 3838
  Gene Symbol: COL18A1
  Gene Name: collagen, type XVIII, alpha 1
  Uniprot ID: P39060
  ENST ID: ENST00000355480
  CDS Start-End: 43-4602
agaggccctcccgccgcccgcagctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 121593 - DNA, 6586 bp, Homo sapiens
  Payload ID: 3838
  Gene Symbol: COL18A1
  Gene Name: collagen, type XVIII, alpha 1
  Uniprot ID: P39060
  ENST ID: ENST00000359759
  CDS Start-End: 1-5265
atggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactg

SEQ ID NO: 121594 - DNA, 5436 bp, Homo sapiens
  Payload ID: 3838
  Gene Symbol: COL18A1
  Gene Name: collagen, type XVIII, alpha 1
  Uniprot ID: P39060
  ENST ID: ENST00000400337
  CDS Start-End: 95-4114
ctcccagcggcggcggctgcagcgcggcggtccgagcgggtgcaccgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 121595 - DNA, 839 bp, Homo sapiens
  Payload ID: 3838
  Gene Symbol: COL18A1
  Gene Name: collagen, type XVIII, alpha 1
  ENST ID: ENST00000423214
  CDS Start-End: 1-839
ctatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcgg

SEQ ID NO: 121596 - DNA, 4172 bp, Homo sapiens
  Payload ID: 3839
  Gene Symbol: COL20A1
  Gene Name: collagen, type XX, alpha 1
  Uniprot ID: Q9P218
  ENST ID: ENST00000358894
  CDS Start-End: 101-3955
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 121597 - DNA, 750 bp, Homo sapiens
  Payload ID: 3839
  Gene Symbol: COL20A1
  Gene Name: collagen, type XX, alpha 1
  ENST ID: ENST00000455906
  CDS Start-End: 1-750
gagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggc

SEQ ID NO: 121598 - DNA, 1204 bp, Homo sapiens
  Payload ID: 3839
  Gene Symbol: COL20A1
  Gene Name: collagen, type XX, alpha 1
  ENST ID: ENST00000415763
  CDS Start-End: 1-1204
gagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagag

SEQ ID NO: 121599 - DNA, 8097 bp, Homo sapiens
  Payload ID: 3839
  Gene Symbol: COL20A1
  Gene Name: collagen, type XX, alpha 1
  Uniprot ID: Q9P218
  ENST ID: ENST00000422202
  CDS Start-End: 69-3962
gtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctggtgggtcagagtggagagagaccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacagaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggc

SEQ ID NO: 121600 - DNA, 4339 bp, Homo sapiens
  Payload ID: 3840
  Gene Symbol: COL21A1
  Gene Name: collagen, type XXI, alpha 1
  Uniprot ID: Q96P44
  ENST ID: ENST00000244728
  CDS Start-End: 399-3272
attttctgatgctagcaggatttgaactgagtgtttccaccagggcgacactagcagttcgcccttcaagatccagatccaaaatccaccctctggtcttcggccaaggaaagggggcgggtggggagcgcgaaccttatctcccgggctccgcctccagggggctgagagcgagtttctgagcctctgagctctgcactggccgctgcagggagaacggactccgggcggagggcagccaatccgtttcagcgcaggtcttgctcgggttgggcttgccactgcctggaacatacctgtccccctggcgcaacactcagctggctgcgacggcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 121601 - DNA, 624 bp, Homo sapiens
  Payload ID: 3840
  Gene Symbol: COL21A1
  Gene Name: collagen, type XXI, alpha 1
  ENST ID: ENST00000370817
  CDS Start-End: 216-624
gcaacactcagctggctgcgacggcaaccccgagcctggacactgcgccaggaaacctcttctggcatccttagtaaatggcagtagagtcatctgggaggtaaaagaagattgtaccatgtgagggatctcctacccaggaaacaaagcccacaggaagaccatcacataggaatggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgacta

SEQ ID NO: 121602 - DNA, 4094 bp, Homo sapiens
  Payload ID: 3840
  Gene Symbol: COL21A1
  Gene Name: collagen, type XXI, alpha 1
  Uniprot ID: Q96P44
  ENST ID: ENST00000370819
  CDS Start-End: 163-3027
tggttctggccaagggagttcatacccactcaaagattatattacgaatttcagatgggagcttctctcaacctgcagccaccacatgagttagctggccgacttctgtgaggttcccagtgaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggattttgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 121603 - DNA, 480 bp, Homo sapiens
  Payload ID: 3840
  Gene Symbol: COL21A1
  Gene Name: collagen, type XXI, alpha 1
  ENST ID: ENST00000456983
  CDS Start-End: 1-377
accgggagacagcatgtgagattcctggatttaatggagagtgccttaatggtcccagtgatgtaggttcaactccagctccctgtatttgtcctccgggaaaaccaggacttcaaggccccaaaggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggaagtatagatcacacaacaaagtattcatattgaacttttaatgtaatggaaacagaaaactagaattgcagttctaacccagcattagaacagttagctctgttcacccttcttaggggattaattcagaacaatg

SEQ ID NO: 121604 - DNA, 2327 bp, Homo sapiens
  Payload ID: 3840
  Gene Symbol: COL21A1
  Gene Name: collagen, type XXI, alpha 1
  ENST ID: ENST00000488912
  CDS Start-End: 1-240
gccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctacatgtgcatatgagttcagccacgtgaaagagtgacctgtacttctttatgtctcttcacaaactgtggtcttcatattcttcatgattgcatcaggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagaggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 121605 - DNA, 3369 bp, Homo sapiens
  Payload ID: 3840
  Gene Symbol: COL21A1
  Gene Name: collagen, type XXI, alpha 1
  ENST ID: ENST00000535941
  CDS Start-End: 162-3032
aacactcagctggctgcgacggcaaccccgagcctggacactgcgccaggaaacctcttctggcatccttagtaaatggcagtagagtcatctgggaggtaaaagaagattgtaccatgtgaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttgtaaagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgca

SEQ ID NO: 121606 - DNA, 6346 bp, Homo sapiens
  Payload ID: 3841
  Gene Symbol: COL22A1
  Gene Name: collagen, type XXII, alpha 1
  Uniprot ID: Q8NFW1
  ENST ID: ENST00000303045
  CDS Start-End: 448-5328
ggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaaggctgcttgcggaaaagtcagagggtcagaaaactgtgcactgggagggcaatgtgttaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttga

SEQ ID NO: 121607 - DNA, 4355 bp, Homo sapiens
  Payload ID: 3841
  Gene Symbol: COL22A1
  Gene Name: collagen, type XXII, alpha 1
  Uniprot ID: Q8NFW1
  ENST ID: ENST00000435777
  CDS Start-End: 40-3999
cctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcc

SEQ ID NO: 121608 - DNA, 554 bp, Homo sapiens
  Payload ID: 3841
  Gene Symbol: COL22A1
  Gene Name: collagen, type XXII, alpha 1
  ENST ID: ENST00000522546
  CDS Start-End: 1-198
ggggagccaggagagctgggagagccggggctgccgggtgaggtcggcatgcgggggccccaaggaccacctggactccccggacctcctggacgtgtcggagctcctgtaagtgaaggcacttgtctgggcaggggttctaccccttctccaggaatcaaaaaccaggttctagcaagttcctccacctgcatctagacagtaatgctgttttgccttactgatgccaatgaagtgttggtatctcctttcttagaccagaaattattagatgttacagtccataagaatcacccagagaacaagtttaaatgcatattcctgggacccctttctcacatcaagaagcagggtagatcccaggaatctgcatttttaaccagcaccacaggatttttgacacttgatctaaagaattcattttccccagcctgtcctgtactgtactcttgtaagaagggtggagtctactgaattcttagcccctggaacagtgccagactgtccagtatggtgttcagtatgtccagtgaataaagagatgaacaaacaga

SEQ ID NO: 121609 - DNA, 3061 bp, Homo sapiens
  Payload ID: 3842
  Gene Symbol: COL23A1
  Gene Name: collagen, type XXIII, alpha 1
  Uniprot ID: Q86Y22
  ENST ID: ENST00000390654
  CDS Start-End: 359-1981
agaggtgcgcgctgcgcgtgggatcagcccggcgccgacgggtggctccgaggagctcgctccttcctcgcccccgccccctcgccgcgcggggccagcccggccgctcctcccctgggtgggtccctgctccttttctggcagggtctatttgcatagaggaaactgcccaaagtggccgctgtggaggagctggctgcggcgaagggggcgtgcgcggcgatccgctgctacccggaggctaacccccgcgcccggcggacctcgtgcctcgggctgtcccgcctgctcctctcgcacccagcctctgccccagcagcaccgccccctcggagagtccacgcgcgacgaacgcgccatgggcccaggcgagcgcgccggtggcggcggcgacgcggggaagggcaatgcggcgggcggcggcggcggagggcgctcggcgacgacggccgggtcccgggcggtgagcgcgctgtgcctgctgctctccgtgggctcggcggctgcctgcctgctgctgggtgtccaggcggccgcgctgcagggccgggtggcggcgctcgaggaggagcgggagctgctgcggcgcgcggggccgccaggcgccctggacgcctgggccgagccgcacctggagcgcctgctgcgggagaagttggacggactagcgaagatccggactgctcgggaagctccatccgaatgtgtctgccccccagggccccctggacggcgcggcaagcctgggagaagaggcgaccctggtcctccagggcaatcaggacgagatggctacccgggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcgaggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtc

SEQ ID NO: 121610 - DNA, 2329 bp, Homo sapiens
  Payload ID: 3842
  Gene Symbol: COL23A1
  Gene Name: collagen, type XXIII, alpha 1
  ENST ID: ENST00000407622
  CDS Start-End: 70-1251
tgttttcctgtctagggccccctggacggcgcggcaagcctgggagaagaggcgaccctggttttccagggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcgaggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtg

SEQ ID NO: 121611 - DNA, 6825 bp, Homo sapiens
  Payload ID: 3843
  Gene Symbol: COL24A1
  Gene Name: collagen, type XXIV, alpha 1
  Uniprot ID: Q17RW2
  ENST ID: ENST00000370571
  CDS Start-End: 368-5512
acagagtcgcctttgaaccgcaagtgaacttgagtgctgcactagcagcccggctcccgctgccgccggcgccccgaggcctcccagtgaggtttacctcctcgcccgccctccccggggagcgcaaccctgggctcgttcgttaccgagccagagagctaggaagcctgtcctccccttcgggtgctatttcctacctcctcccgacttcaccccctcccctcctttttttcttgttgcgggtttgaagcatggttttcatgtgattgttttttccctttttcatggacagtacctgcaccctaagcagttcagagttggcttctgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggagtcatttttaaaaatgatgcttatatcgagacacctttcgtgaaaattttaccagtcaacttggggcagccgtttacaatattaactgggttacagtcacatcgggtgaacaatgcatttctcttcagcattagaaataaaaatagactgcaattaggagtacaattactacctaaaaaattagtagtacacattagaggaaagcagcctgcagttttcaactacagtgttcatgatgagcaatggcactcatttgccattactattagaaaccaaagtgtctcaatgtttgttgagtgtggaaagaaatattttagcacagagactattccagaagttcagacctttgattctaatagtgtgtttactttaggaagtatgaataataattctatccattttgaaggaatagtatgtcagttagatattattccttctgcagaagcatctgcagactactgcagatatgtgaaacagcagtgtcgccaagcagacaaataccaacctgaaacaagcattccttgtacaactctcataccaacaaagataccggaacactctcccccgcccaaactatttgctgaaaaagtactgtcagaggatacatttactgaaggcaaaagcattccaaatatcataaaaaatgattctgaaaccgtgtataaaagacaagaacaccagatatcaagatctcagttatcttctcttcagtcaggaaatgtctctgctgtggatctcacaaaccatgggattcaggccaaagaaatgatcactgaggaagatactcagacaaatttcagcctgtcagtgaccactcatcgcatcagtgaggcaaaaatgaataccaaagagaaatttagctctctcctaaacatgtctgacaatatcacacaacatgatgatagagtaactggtctgtcactgtttaagaagatgccatctattcttccacaaattaaacaagatacaattactaatctcaagaaggctatcacagcaaatctacacactaacgaactcatggaaatgcaaccaattttaaacacaagcttgcatagagtgacaaatgagccatctgtggataatcaccttgatctaaggaaagaaggtgaattttatcctgatgctacttatcccatcgaaaatagctatgaaactgagctttatgattattattattatgaggatctaaatacaatgcttgaaatggagtatctgagagggccaaaaggagacactggacctcccggtccacctggtccagcaggtatcccaggtccgtcagggaagagaggtccacggggcataccagggccacatggaaatcctggtttacctggattacctggtccaaagggccccaaaggagatccaggattttccccaggtcaacctgttcctggagaaaagggtgatcaaggcctttctggattaatgggcccccctggtatgcaaggtgataagggtctcaaaggacatcctggactcccaggacttccaggtgaacaaggaattccaggatttgctggtaatattggttcacccggttaccctggcaggcagggtttagctggaccagaaggtaatccaggtcctaaaggtgcacaaggttttattggctctcctggagaagcgggacaactgggacctgaaggagaacggggcattcctgggatccgtggaaagaagggttttaaggggagacagggttttccaggtgactttggagacagaggccctgctggtcttgatggcagtcctggacttgtaggtggcactggtcctccggggtttcctgggcttagaggcagtgttggccctgtgggaccaattggacctgctggaattcctggcccaatgggcctttcagggaataaaggactacctggaatcaaaggtgataagggtgaacaaggcacagcaggagagctaggagaacccgggtatcctggagacaagggtgctgttggtttaccaggaccaccagggatgagaggaaagtcagggccttcaggccaaacaggtgacccaggactccaaggaccatctggccctccaggaccagagggttttccaggagatattgggattcctggacaaaacggccctgaaggaccaaagggactccttggaaatagaggacctcctggacctcctggtctcaaaggaactcagggagaagaaggaccaattggagcctttggggaactggggccaagaggaaaaccaggtcaaaaggggtatgcaggtgaaccaggaccagaaggcttaaagggagaagtaggagatcaaggaaatattggaaaaattggtgaaacaggacctgttggcttacctggagaagttgggatgactggaagcattggcgaaaagggagaacgtggaagtccaggcccactaggtccgcagggagaaaaaggtgttatgggatatccaggtcctcctggggttccaggacctatcggtccattgggattacctggtcatgtgggggcaagaggaccacctgggagtcaaggtcctaaaggacaaagaggatcaagaggaccagatggtctcttaggggaacaaggtatacaaggtgccaagggtgaaaaaggagatcaaggaaaaagagggcctcatggtcttattggtaagactggaaaccctggagaaagaggatttcaagggaaaccaggtttacagggattgcctggaagtacaggtgacagaggacttccaggagagccaggactgcgaggactgcaaggtgatgttggacctcctggagaaatgggcatggagggacctccaggcactgagggagagtctggtctgcaaggtgaaccaggtgcaaagggagatgttggaactgctggcagtgttggaggaactggggaaccaggtttacggggtgaaccaggagctcctggagaagaaggtctccagggaaaagatgggttaaagggagtaccaggaggaaggggacttcctggagaggatggagaaaaaggagagatgggcttaccaggaattataggacccttgggtagatcaggccaaacaggccttccgggacctgaaggaattgtgggaattccagggcaaagaggtcgtccaggaaaaaagggtgataaaggacaaataggacccacaggagaagttggaagcagaggtcctcctggaaaaattgggaaaagtggtcctaagggtgccagaggaactagaggtgctgtgggacatttaggattgatgggacctgatggagaaccaggaattccagggtacaggggccatcagggccaaccaggaccctctggattgccaggacctaaaggagaaaagggctacccaggagaagatagcacagtcctaggaccacctgggcctcgaggtgaaccaggtccagtgggggaccaaggagagagaggagagcctggagcagagggatataagggccatgtgggtgtaccaggactaagaggtgccactggacaacaaggacccccaggcgaaccaggtgaccagggtgaacaaggactaaaaggagagagaggatctgaaggtaataaggggaaaaaaggagctcctggtccttctgggaaacctgggattcctggacttcaaggcctacttgggccaaaaggcatacaaggataccatggagcagatggcatttcaggaaaccctggaaaaattgggccaccaggaaaacagggacttcctggcatcagaggcggcccaggaagaacaggtcttgctggggctccaggtcctccaggagtaaagggttcatcaggcttgccaggaagcccaggaattcaaggcccaaagggtgaacaagggctacctggtcaacctggaattcaaggtaaaagaggtcaccgaggagcacaaggtgatcaaggaccatgtggagaccctggcctgaaagggcagcctggagaatatggtgttcaaggtttgacaggtttccaaggattcccaggccctaaaggtcctgaaggggatgctggcattgttgggatatcaggtcctaaaggtcctattggacacagaggaaacactggtccccttggcagagaaggtataataggcccaacaggtagaactggacccagaggtgaaaagggctttagaggtgaaactggtcctcaaggaccaagaggtcaaccagggcctccaggtccacctggagcaccaggcccaagaaagcaaatggatatcaatgctgctattcaagccttgattgaatcaaatactgccctacagatggagagctaccagaatactgaagtgactttaattgaccacagtgaagagatattcaaaaccctgaactaccttagcaatttattgcacagcatcaagaatcctcttggcacacgagataacccagcacgaatctgcaaagatttacttaactgtgaacaaaaagtatcagatggaaaatactggattgacccaaatcttggctgtccttcagatgccattgaggttttctgcaatttcagtgctggtggccagacatgcttacctcctgtttctgtaacaaagttggagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaacactctacttgaacctaaagtgctttcagatgactgcaagattcaagatggcagctggcataaggcaacatttctttttcacacccaggaacctaatcaacttccagtgattgaagtacaaaaacttcctcatctcaaaactgaacgaaagtattacattgacagcagttctgtatgctttctgtaaagtctctgaattagttccgaattcaggctgttggccaggtaattgctgcagagggagaaataagacagacagatacagtcattatgaaatgcatgtaataaagcattggctaaatcttaaagaatctcaggaagaacagacttcctcctaagaaggagaaaaggcatttttaaaggactatgattgataaagtatttaattcttttaaaaattatattcatctcagctttcttagagaattccctagaactaaaaatttataaatatggaattcttcagggtatcttatatttttgactgagtgcgtagtacccattagacagctggagatgcagagcactatggagcaatactggctaatgcttccagatgtgcactgcttctgtctaaaaattacaagccacagtctaatatgtcttattttccaaaacactaagctgtattcaggtccccgatgggcatatacatcttagccggtgatacactacctcttacgtgttgcctctttgtgttgcttggtgctctttcgaaaacaaggtgcttatggctttcatagactatttcctttttcatctttgtcattctttaaaagtgtatgtactggttacatcaagatatgttttggttgttagtacttattttaatttgtttggtcacacacttaataacacgtgaaactatttatgtgaagtccttgttttattttaaaattctctttgtgtatttggaatcaaagccagcacattgtaacctgtgcttgtacgcaaaagaattagatttctttgtttttgttttattttttaaattgttgtaaaaattattataggccagctacatctagtagtaggtttggggtacagattgggggttgtgccatactgtttttaaagttcatgatcatctggaatgatacttagtgtatatatattttgtaaagttttaattcagcaaattttttgaaattgctgctgttttaaattataaaacctttatatttctgctttgtagaaattatatgttttgtagtattcattgattttctttcactgtacttaaatttagtgttagtactttaaaatttttaatttaccagtctttaaagcaacatccagaaaaaaaaaagtcttttcccatttaaaataggctcagccagttcaatgtctccttgttatcagagaaatattagttcaatactgaaagaaaaatattatacctcttggtatctagaaaagcttgttcatccattataaatatatctttagccacagcaaaccacacttaacctatctataataaaaatgtgctttaaataa

SEQ ID NO: 121612 - DNA, 6036 bp, Homo sapiens
  Payload ID: 3843
  Gene Symbol: COL24A1
  Gene Name: collagen, type XXIV, alpha 1
  ENST ID: ENST00000426639
  CDS Start-End: 368-3040
acagagtcgcctttgaaccgcaagtgaacttgagtgctgcactagcagcccggctcccgctgccgccggcgccccgaggcctcccagtgaggtttacctcctcgcccgccctccccggggagcgcaaccctgggctcgttcgttaccgagccagagagctaggaagcctgtcctccccttcgggtgctatttcctacctcctcccgacttcaccccctcccctcctttttttcttgttgcgggtttgaagcatggttttcatgtgattgttttttccctttttcatggacagtacctgcaccctaagcagttcagagttggcttctgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggagtcatttttaaaaatgatgcttatatcgagacacctttcgtgaaaattttaccagtcaacttggggcagccgtttacaatattaactgggttacagtcacatcgggtgaacaatgcatttctcttcagcattagaaataaaaatagactgcaattaggagtacaattactacctaaaaaattagtagtacacattagaggaaagcagcctgcagttttcaactacagtgttcatgatgagcaatggcactcatttgccattactattagaaaccaaagtgtctcaatgtttgttgagtgtggaaagaaatattttagcacagagactattccagaagttcagacctttgattctaatagtgtgtttactttaggaagtatgaataataattctatccattttgaaggaatagtatgtcagttagatattattccttctgcagaagcatctgcagactactgcagatatgtgaaacagcagtgtcgccaagcagacaaataccaacctgaaacaagcattccttgtacaactctcataccaacaaagataccggaacactctcccccgcccaaactatttgctgaaaaagtactgtcagaggatacatttactgaaggcaaaagcattccaaatatcataaaaaatgattctgaaaccgtgtataaaagacaagaacaccagatatcaagatctcagttatcttctcttcagtcaggaaatgtctctgctgtggatctcacaaaccatgggattcaggccaaagaaatgatcactgaggaagatactcagacaaatttcagcctgtcagtgaccactcatcgcatcagtgaggcaaaaatgaataccaaagagaaatttagctctctcctaaacatgtctgacaatatcacacaacatgatgatagagtaactggtctgtcactgtttaagaagatgccatctattcttccacaaattaaacaagatacaattactaatctcaagaaggctatcacagcaaatctacacactaacgaactcatggaaatgcaaccaattttaaacacaagcttgcatagagtgacaaatgagccatctgtggataatcaccttgatctaaggaaagaaggtgaattttatcctgatgctacttatcccatcgaaaatagctatgaaactgagctttatgattattattattatgaggatctaaatacaatgcttgaaatggagtatctgagagggccaaaaggagacactggacctcccggtccacctggtccagcaggtatcccaggtccgtcagggaagagaggtccacggggcataccagggccacatggaaatcctggtttacctggattacctggtccaaagggccccaaaggagatccaggattttccccaggtcaacctgttcctggagaaaagggtgatcaaggcctttctggattaatgggcccccctggtatgcaaggtgataagggtctcaaaggacatcctggactcccaggacttccaggtgaacaaggaattccaggatttgctggtaatattggttcacccggttaccctggcaggcagggtttagctggaccagaaggtaatccaggtcctaaaggtgcacaaggttttattggctctcctggagaagcgggacaactgggacctgaaggagaacggggcattcctgggatccgtggaaagaagggttttaaggggagacagggttttccaggtgactttggagacagaggccctgctggtcttgatggcagtcctggacttgtaggtggcactggtcctccggggtttcctgggcttagaggcagtgttggccctgtgggaccaattggacctgctggaattcctggcccaatgggcctttcagggaataaaggactacctggaatcaaaggtgataagggtgaacaaggcacagcaggagagctaggagaacccgggtatcctggagacaagggtgctgttggtttaccaggaccaccagggatgagaggaaagtcagggccttcaggccaaacaggtgacccaggactccaaggaccatctggccctccaggaccagagggttttccaggagatattgggattcctggacaaaacggccctgaaggaccaaagggactccttggaaatagaggacctcctggacctcctggtctcaaaggaactcagggagaagaaggaccaattggagcctttggggaactggggccaagaggaaaaccaggtcaaaaggggtatgcaggtgaaccaggaccagaaggcttaaagggagaagtaggagatcaaggaaatattggaaaaattggtgaaacaatggagtcttgctctgtcacccaagctggagcacagtggcatgatcttggctcactgcatcctctgcctcccgggttcaagcgattctcctgcctcagcctcccgggatagctggaattacagggacctgttggcttacctggagaagttgggatgactggaagcattggcgaaaagggagaacgtggaagtccaggcccactaggtccgcagggagaaaaaggtgttatgggatatccaggtcctcctggggttccaggacctatcggtccattgggattacctggtcatgtgggggcaagaggaccacctgggagtcaaggtcctaaaggacaaagaggatcaagaggaccagatggtctcttaggggaacaaggtatacaaggtgccaagggtgaaaaaggagatcaaggaaaaagagggcctcatggtcttattggtaagactggaaaccctggagaaagaggatttcaagggaaaccaggtttacagggattgcctggaagtacaggtgacagaggacttccaggagagccaggactgcgaggactgcaaggtgatgttggacctcctggagaaatgggcatggagggacctccaggcactgagggagagtctggtctgcaaggtgaaccaggtgcaaagggagatgttggaactgctggcagtgttggaggaactggggaaccaggtttacggggtgaaccaggagctcctggagaagaaggtctccagggaaaagatgggttaaagggagtaccaggaggaaggggacttcctggagaggatggagaaaaaggagagatgggcttaccaggaattataggacccttgggtagatcaggccaaacaggccttccgggacctgaaggaattgtgggaattccagggcaaagaggtcgtccaggaaaaaagggtgataaaggacaaataggacccacaggagaagttggaagcagaggtcctcctggaaaaattgggaaaagtggtcctaagggtgccagaggaactagaggtgctgtgggacatttaggattgatgggacctgatggagaaccaggaattccagggtacaggggccatcagggccaaccaggaccctctggattgccaggacctaaaggagaaaagggctacccaggagaagatagcacagtcctaggaccacctgggcctcgaggtgaaccaggtccagtgggggaccaaggagagagaggagagcctggagcagagggatataagggccatgtgggtgtaccaggactaagaggtgccactggacaacaaggacccccaggcgaaccaggtgaccagggtgaacaaggactaaaaggagagagaggatctgaaggtaataaggggaaaaaaggagctcctggtccttctgggaaacctgggattcctggacttcaaggcctacttgggccaaaaggcatacaaggataccatggagcagatggcatttcaggaaaccctggaaaaattgggccaccaggaaaacagggacttcctggcatcagaggcggcccaggaagaacaggtcttgctggggctccaggtcctccaggagtaaagggttcatcaggcttgccaggaagcccaggaattcaaggcccaaagggtgaacaagggctacctggtcaacctggaattcaaggtaaaagaggtcaccgaggagcacaaggtgatcaaggaccatgtggagaccctggcctgaaagggcagcctggagaatatggtgttcaaggtttgacaggtttccaaggattcccaggccctaaaggtcctgaaggggatgctggcattgttgggatatcaggtcctaaaggtcctattggacacagaggaaacactggtccccttggcagagaaggtataataggcccaacaggtagaactggacccagaggtgaaaagggctttagaggtgaaactaagcaaatggatatcaatgctgctattcaagccttgattgaatcaaatactgccctacagatggagagctaccagaatactgaagtgactttaattgaccacagtgaagagatattcaaaaccctgaactaccttagcaatttattgcacagcatcaagaatcctcttggcacacgagataacccagcacgaatctgcaaagatttacttaactgtgaacaaaaagtatcagatggaaaatactggattgacccaaatcttggctgtccttcagatgccattgaggttttctgcaatttcagtgctggtggccagacatgcttacctcctgtttctgtaacaaagttggagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaacactctacttgaacctaaagtgctttcagatgactgcaagattcaagatggcagctggcataaggcaacatttctttttcacacccaggaacctaatcaacttccagtgattgaagtacaaaaacttcctcatctcaaaactgaacgaaagtattacattgacagcagttctgtatgctttctgtaaagtctctgaattagttccgaattcaggctgttggccaggtaattgctgcagagggagaaataagacagacagatacagtcattatgaaatgcatgtaataaagcattggctaaatcttaaagaatctcaggaagaacagacttcctcctaagaaggagaaaaggcatttttaaaggactatgattgataaagtatttaattcttttaaaaattatattcatctcagctttcttagagaattccctagaactaaaaatttataaatatggaattcttcagggtatcttatatttttgactgagtgcgtagtacccattagacagctggagatgcagagcactatggagcaatactggctaatgcttccagatgtgcactgcttctgtctaaaaattacaagccacagtctaatatgtcttattttccaaaacactaagctgtattcaggtccccgatgggcatat

SEQ ID NO: 121613 - DNA, 784 bp, Homo sapiens
  Payload ID: 3843
  Gene Symbol: COL24A1
  Gene Name: collagen, type XXIV, alpha 1
  ENST ID: ENST00000473734
  CDS Start-End: 1-500
gcatcaagaatcctcttggcacacgagataacccagcacgaatctgcaaagatttacttaactgtgaacaaaaagtatcagatggaaaatactggattgacccaaatcttggctgtccttcagatgccattgaggttttctgcaatttcagtgctggtggccagacatgcttacctcctgtttctgtaacaaaggcattcaccattattacccctgaaatagaagagggaaggatccttccattcctagggaatcatgaacctctaataaagagcagcatgatagtcctacttccaaaatatccacatcatcatcctcattccagtggaagttggcataggattatcatagaaggaaagaagatggggctgtgtgaactgtgcagaggaaataggagcagtggggaagcggactctagttgtttccatgaccaaatcacttctctaatttctttgattcataaactcaacccaaggaagaccagagaagtactgggatgaacagtagacttggaatcagggactggggttctagtctctattctatgaacctagggaataaaactgtgatccaccagagggcctgctctgtgccaggaacaatgctagttggagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaa

SEQ ID NO: 121614 - DNA, 366 bp, Homo sapiens
  Payload ID: 3843
  Gene Symbol: COL24A1
  Gene Name: collagen, type XXIV, alpha 1
  ENST ID: ENST00000496682
  CDS Start-End: 123-366
gcgcctgcagttgccaccggccccctcgcaccgacttgatttccgaatacctgcaccctaagcagttcagagttggcttctgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggag

SEQ ID NO: 121615 - DNA, 2674 bp, Homo sapiens
  Payload ID: 3844
  Gene Symbol: COL25A1
  Gene Name: collagen, type XXV, alpha 1
  Uniprot ID: Q9BXS0
  ENST ID: ENST00000399126
  CDS Start-End: 532-2460
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaa

SEQ ID NO: 121616 - DNA, 2500 bp, Homo sapiens
  Payload ID: 3844
  Gene Symbol: COL25A1
  Gene Name: collagen, type XXV, alpha 1
  ENST ID: ENST00000399127
  CDS Start-End: 349-2286
gagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggggcctgccaggcttccccacagttgctgccctgcacagtaatcagatcctcaccgtcaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaagggggatcgtggagaaaaaggggactctggagctcagggaccaaggggtccacctggtcaaaaaggggatcaaggagccactgagatcatagactacaacggcaacctccacgaagccttacagggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtgaaccagggttaaatggtgttaaaggattgaagggtgaaccaggtcaaaagggtgacagaggaccccttggtcttccaggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaa

SEQ ID NO: 121617 - DNA, 2724 bp, Homo sapiens
  Payload ID: 3844
  Gene Symbol: COL25A1
  Gene Name: collagen, type XXV, alpha 1
  Uniprot ID: Q9BXS0
  ENST ID: ENST00000399132
  CDS Start-End: 532-2496
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 121618 - DNA, 428 bp, Homo sapiens
  Payload ID: 3844
  Gene Symbol: COL25A1
  Gene Name: collagen, type XXV, alpha 1
  ENST ID: ENST00000505591
  CDS Start-End: 218-428
gatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaag

SEQ ID NO: 121619 - DNA, 316 bp, Homo sapiens
  Payload ID: 3844
  Gene Symbol: COL25A1
  Gene Name: collagen, type XXV, alpha 1
  ENST ID: ENST00000512961
  CDS Start-End: 1-88
tggtccacggggtgagaagggtgatctaggagaaaagggagaaaaggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 121620 - DNA, 4630 bp, Homo sapiens
  Payload ID: 3844
  Gene Symbol: COL25A1
  Gene Name: collagen, type XXV, alpha 1
  ENST ID: ENST00000494183
  CDS Start-End: 122-1612
gagcggccactgttggggccctcgaaagaggtgtcggtcctctgggagtcggaagagctgtctgggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccagggagccaatggaatgaaaggagaaaaaggagattctggaatgccgggtccacagggtccttctatcataggcccaccaggcccaccaggtccccatggcccacctggccccatgggacctcatggacttcctggaccaaagggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggggaaaagggaaagaaaggcaaaaaggggcctaaaggggagaaaggagaacagggtgctcctggattagatgcaccctgcccgttggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 121621 - DNA, 4799 bp, Homo sapiens
  Payload ID: 3844
  Gene Symbol: COL25A1
  Gene Name: collagen, type XXV, alpha 1
  ENST ID: ENST00000610288
  CDS Start-End: 342-1343
caggccctccagggaaacgaggtaagagaggccgaagaggagaatctggtaagtctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccagggagccaatggaatgaaaggagaaaaaggagattctggaatgccgggtccacagggtccttctatcataggcccaccaggcccaccaggtccccatggcccacctggccccatgggacctcatggacttcctggaccaaagggagcatctggcttagacggaaagccaggatcccggggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacaggtatttttcattctttttaatgcttttttctttttctttctttagtcccaagaatattgaaaaaatattagtttcagtttttgtcacatatgttttgaacaatttttttaagaagtcttcaaatcataataatttggctccagtagtcaaaatgaccttttactaacttctctcttgttttggataattggatagaatataaaagaagctccactttcagtctaatcattgtaaagcatgaaagttatgcatttttaagtagttttgactttttttacatgatgaatgtaacgtacatggagattatcagttaatataaagccaagattttgtcacatttggtaatattaactaatttctatttttatggttttaagttttgtctatatttagatttctttctctttttaacatttctaaatgtttgtctcatcctcatatccacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 121622 - DNA, 4819 bp, Homo sapiens
  Payload ID: 3844
  Gene Symbol: COL25A1
  Gene Name: collagen, type XXV, alpha 1
  ENST ID: ENST00000622134
  CDS Start-End: 129-1613
caggccctccagggaaacgaggtaagagaggccgaagaggagaatctggtaagtctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatggcaaaaggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacaggcaagtaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctccttatcttatgtgaagatacgtatttatatggacaaatcagtggtagagaatgattgattgtactagctattttccttcttttggcttgctaattgcatggacaaaaagtgccatgaaatagtttacatgaaatggtgaccaaatatggactcaaagctatgaaaatgtactatactgactgattttagagctgattatcacattcccattcacctttcatgtcggcgttgactcatacctacaccacccattgaaactaactaaaaaagcatgactgtgtgccaaacctgcttgctgtgcaacttcagatgctagcatgttgatcaggagtcctttgattacatctgaacctttattccttttgtcatctcaagggggttacaccatggcttattgccaaaaagagataaggtggcggagagcacacacacaatttgtcttgtattttgagggagttgcagtcctgactgcagatctacagcttccagtattgtgggctcatgtggccactttggttgaaatacgaaggggttgagcctgttgctgccaccagttttccttgggctgcccttggcagtgaagacatgggaagaggaccgattcagcctccagcactgcctctcatgtgaccaagtaggaaagaggtttacaaatgcaaacatgcagaaccacagactttaaaaatatgtataaataaactgaatttcagcaagtgttaatataggtgcttttaaaaatgacagaggcacagcacttcttttggaataggagattcttggaatgggagatcctgtccctgagggaaaagggatgtccatcccaccaaaacttgggttgctgaagaaataacatgttctgagaagggatcagccaaaatcgcctctcccgatgatataggagagcttactgggacaatctgtgccaaagttgttgtgagagctttccttcctcctacgatccaaccatgtcaaacatttcctacaaagtttgagaaacaggtatttttcattctttttaatgcttttttctttttctttctttagtcccaagaatattgaaaaaatattagtttcagtttttgtcacatatgttttgaacaatttttttaagaagtcttcaaatcataataatttggctccagtagtcaaaatgaccttttactaacttctctcttgttttggataattggatagaatataaaagaagctccactttcagtctaatcattgtaaagcatgaaagttatgcatttttaagtagttttgactttttttacatgatgaatgtaacgtacatggagattatcagttaatataaagccaagattttgtcacatttggtaatattaactaatttctatttttatggttttaagttttgtctatatttagatttctttctctttttaacatttctaaatgtttgtctcatcctcatatccacagaccaaatctaagatctcagaaagctgtgaaatatagttgccataaagaaaatatttttcatctacttgctcaaactttacctaaccatattagatggaacatttctttgcacagtaaagagttggtagcgtgttttgaaatggcttattctaagtggaagtgttacattgaaagaaacattatcaatgaggagtaggcaccctttcagcccattagagaatttaatttctctcctgactcaatgccatcttctgggaagatttctagtttcatgcataggtgtcaccaccagaagggaaattaactcatccttggcttatagttaagatataaccataagacaaggaacctaaaatcctcatgatctcatttatgttatgtaaccaaatgacagtcatacaaaatggcatcttcttttttttctattaaatttttaaggttgaaagatgtttaaactattagatcagtctaattggtaacatttctggtaacattccacacccctaagccagtttagcattttgaaaataatggaggacattttctaacaatttcttgtatggcatggtgttaggataacgtattgctcaatgtctgacacaatttgtcttaaatggtttggaaaaatgaactgaagtgggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggatagcaaattgatatgtgttttagatttaaaattgtttttcatttatgttggttggtgctaatgtatctcttttcctttttctctatggacaatacaactactatggataattttatttccctgtttaatagcattcctaaatcattagtgtgttattttatttttaaagttcatgaatttgctataattatggtccaatgaccaggctttcttaatgtaaaacaaaacagtgtaccaatagatgatgtgtgtttactcgga

SEQ ID NO: 121623 - DNA, 3033 bp, Homo sapiens
  Payload ID: 3845
  Gene Symbol: COL26A1
  Gene Name: collagen, type XXVI, alpha 1
  Uniprot ID: Q96A83
  ENST ID: ENST00000313669
  CDS Start-End: 214-1539
cggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggcactggtgccatcacacagtgacacggacggtgtcctgccaggtgcagaatggctcggagacggtggtccagcgcgtgtaccagagctgccggtggccggggccctgcgccaacctcgtaagttacaggactctgatcagacccacctacagagtgtcctaccgcacggtgacggtgctggagtggagatgctgccctggcttcaccgggagcaactgtgatgaggaatgcatgaactgcacccggctcagtgacatgagtgagcgactgaccacactggaggccaaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccgggcccccggggcagacaggaccaccagggcctgcaggcccccccgggtctaaaggtgaccgaggccagacaggagagaagggtccagcggggccgcctgggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacaatggagactcaaggctggcctctgccatcgtggacacagtgctggcaggtgtcccaggaccccggggtccccctggtccaccaggtccccctgggcctcgaggtcccccaggacccccaggaacacctggatcccagggcctggctggagagcgaggcacagtggggccgtccggtgaacctggcgtgaagggggaagaaggagagaaagccgccactgcagagggcgagggggtgcagcagctgagagaggccctgaagatcctggcagagcgagtcctcatcctggagcacatgattgggatccacgatcccctggcctccccagagggaggttctggccaggatgctgccctgagagccaacctcaagatgaagaggggtggcgcccaacccgatggggtccttgctgccctgcttgggcccgaccctggacagaagagcgtggaccaggccagcagcaggaagtgagagcccactgctccaggacaccctgtcctggctagagacccagccccagaggcctgagccgccgctgtttcctaaagatgcccccaggggaactgggctccaggcatggatgattgtgaggacatggggggctttggggacagataatgtctccaggggcagggtctggaggggccaacaccctcatcagagccctcctctggcctgtcccctcccctacccccactcccggctggagacggggtctgggtgggctgggtgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctgggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtctccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctccccac

SEQ ID NO: 121624 - DNA, 2970 bp, Homo sapiens
  Payload ID: 3845
  Gene Symbol: COL26A1
  Gene Name: collagen, type XXVI, alpha 1
  Uniprot ID: Q96A83
  ENST ID: ENST00000613501
  CDS Start-End: 157-1476
cccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggcactggtgccatcacacagtgacacggacggtgtcctgccaggtgcagaatggctcggagacggtggtccagcgcgtgtaccagagctgccggtggccggggccctgcgccaacctcgtaaggactctgatcagacccacctacagagtgtcctaccgcacggtgacggtgctggagtggagatgctgccctggcttcaccgggagcaactgtgatgaggaatgcatgaactgcacccggctcagtgacatgagtgagcgactgaccacactggaggccaaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccgggcccccggggcagacaggaccaccagggcctgcaggcccccccgggtctaaaggtgaccgaggccagacaggagagaagggtccagcggggccgcctgggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacaatggagactcaaggctggcctctgccatcgtggacacagtgctggcaggtgtcccaggaccccggggtccccctggtccaccaggtccccctgggcctcgaggtcccccaggacccccaggaacacctggatcccagggcctggctggagagcgaggcacagtggggccgtccggtgaacctggcgtgaagggggaagaaggagagaaagccgccactgcagagggcgagggggtgcagcagctgagagaggccctgaagatcctggcagagcgagtcctcatcctggagcacatgattgggatccacgatcccctggcctccccagagggaggttctggccaggatgctgccctgagagccaacctcaagatgaagaggggtggcgcccaacccgatggggtccttgctgccctgcttgggcccgaccctggacagaagagcgtggaccaggccagcagcaggaagtgagagcccactgctccaggacaccctgtcctggctagagacccagccccagaggcctgagccgccgctgtttcctaaagatgcccccaggggaactgggctccaggcatggatgattgtgaggacatggggggctttggggacagataatgtctccaggggcagggtctggaggggccaacaccctcatcagagccctcctctggcctgtcccctcccctacccccactcccggctggagacggggtctgggtgggctgggtgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctgggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtctccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctccccac

SEQ ID NO: 121625 - DNA, 7790 bp, Homo sapiens
  Payload ID: 3846
  Gene Symbol: COL27A1
  Gene Name: collagen, type XXVII, alpha 1
  Uniprot ID: Q8IZC6
  ENST ID: ENST00000356083
  CDS Start-End: 392-5974
cggcggggaggcagcttccaccgccctccgcgcgccctcacccggccttgctctgcctccggggaccgccagcagcccgcctccaaaagtttgatcatctctctctctctttttcttgcttcttcttcctttttggtggaagcagaaaaggaccgaggcaggggcgagcgcggcgcccggactcctgggaccatgggcctggcgcgggcgcccgcggggccccagccgcgctgcctgcctgctcgggcgcccctgggcgcggggctgcgctgggggcgcgggggccgcgcgctctaagccggcctggcgcggcggggcggggggctggcggccccatggggcgcgcccacacttgccccccgggctcgggagcatgaagtaggggcctgccatgggagcgggatcggcgcggggggcccgaggcacagcggcggcggcggcggcgcgcgggggggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggacagaaaggggacccagggctctcaccaggaaaggcccacgatggggcaaagggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaaggtgataagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatgggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaa

SEQ ID NO: 121626 - DNA, 2865 bp, Homo sapiens
  Payload ID: 3846
  Gene Symbol: COL27A1
  Gene Name: collagen, type XXVII, alpha 1
  ENST ID: ENST00000451716
  CDS Start-End: 1-2145
ctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggtccttctaccccaaagttcagaggccagaggtgggaactcaatgccttcagaaggtgccctggctggacgccatggctcacacctgtaatcccaacactttgggaggccaaggcaggcagatcgcttgagcccaggagttcgagaccagcttgggcaacatggagaaaccccatctttaccaaaaatacaaaaattagccaggtgtagtggtgtgcatctgtaatcccagctacttgggaggctgaggcggcaggatcactaggaggcagaggttgcagtgagcagttatcacaccactgcacttcagcctggatgacagagtgagaccctgtatcatgaaaaaaaaagaaggatcccctggacacagcccacctggctgattcttgtcccaggaggtgagacgatctaccttcagcatgaccaagaagagctggtttaggtgagactggaatttaccaggggagaccctaaagatgtgggggaggaagcttgggtaaggtcagatatgcccccacaaagacatgatctggaaacacacacacaccctcccctgccacactcctctgccaccctctgcaaccagttggacacgcgtttgagcagcttctacataccaggctttgcccgtgcatagctcatatgaacatgccaaactccagaggtggacctgggctctgcttgctttatgaccttggccatgtgatgttgcctaaccgagtctcaattttcccatctgtgaaatgggactgataacttttccctcaaagatagatatcaaatgcaaaatgaagtcttgcatgcaaagtga

SEQ ID NO: 121627 - DNA, 5329 bp, Homo sapiens
  Payload ID: 3846
  Gene Symbol: COL27A1
  Gene Name: collagen, type XXVII, alpha 1
  ENST ID: ENST00000494090
  CDS Start-End: 1-1456
ggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaagg

SEQ ID NO: 121628 - DNA, 4277 bp, Homo sapiens
  Payload ID: 3847
  Gene Symbol: COL28A1
  Gene Name: collagen, type XXVIII, alpha 1
  Uniprot ID: Q2UY09
  ENST ID: ENST00000399429
  CDS Start-End: 142-3519
cagaacagaacaatatcaaatagctaacttcacccccaaccacagtccttgctgttggcatttactcaactagtctttaattcctgtttgacaaactttataaggtgctacaagacagatgatttttcaccatctaccataatgtggaacagatattttgtcttctatctcctgcttttgtcagcgtttacgagtcaaacagtatccggacaaagaaagaaaggaccaaaatcaaatttgcttgcaaggaaaagtgatgtccagggctccatttgtttcatagatattgtcttcatcgtggacagctctgaaagttctaaaattgccctctttgataaacagaaagattttgtggatagcttgagtgacaagattttccaattgactcctggtcgctccttggaatatgacatcaaactggcagcccttcagtttagcagctctgtccaaattgatccacctttttcttcctggaaggacctgcagacatttaagcagaaggtcaagtctatgaatttaatagggcaaggtaccttctcttattatgccatttccaatgccactaggctacttaagagagaagggcgtaaggatggtgtgaaagtggttttgctgatgactgatggcatcgaccatccaaagaatccagatgttcaaagtatttctgaagatgccagaatttcaggaatatcatttatcaccattgcactttctacggtagtcaatgaagccaaacttcgtttgatttctggggattcatccagtgaacccactttactgttgagtgatccaacccttgtagataaaattcaagatcgtctggatatcttatttgaaaagaagtgtgaacgcaagatttgtgaatgtgagaagggagatccaggtgatccagggcctcctggtacacatggaaatccaggtatcaaaggtgagcgaggaccaaaaggaaacccgggcaacgctcaaaaaggagaagctggagaaagaggtccagggggaattcctgggtacaagggtgacaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaaggggaacaaggaccacaaggcttcccaggcccaaagggcacaatgggccatggcctcccaggccagaagggagagcacggagaacggggcgatgtgggaaagaaaggtgataaaggagaaattggagagcctggatctccaggaaaacagggtttacaaggacccaaaggagacctaggacttacaaaagaagaaattatcaaacttattacagaaatatgtggttgtgggcccaaatgcaaagagactccactagagctggtgtttgtgatcgacagctcagaaagcgtggggccagagaactttcagatcattaaaaattttgtgaagactatggctgaccgggttgctctggaccttgccacggcccgcataggcataatcaactatagccataaggtggagaaggtggctaatttgaagcagttctccagcaaggatgacttcaagttggctgtggacaacatgcagtatctgggggaaggcacatacacagccactgctctgcaagcagccaacgacatgtttgaagatgcaaggccaggtgtaaaaaaagtggccttggtcatcactgatggacagacagattctcgtgataaagagaaactgacagaggtggtgaagaatgccagtgacaccaatgtggagatatttgtgataggggtggtgaagaaaaatgatcccaactttgaaatattccacaaagaaatgaatctaattgctactgacccagagcatgtttaccagtttgatgatttctttaccctgcaagacaccctgaagcaaaaattgtttcaaaaaatttgtgaggattttgattcctatctcgttcaaatttttggttcatcgtcacctcaacctggatttgggatgtcaggggaagaactcagtgaatctactccagagcctcaaaaagaaatttctgagtcattgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtaaattggcctgtctctatcaaaagcatagaactccctaatttccacatattcacccaatacaaatacagcactatatttgagtgtatactgagtatttacaacttatacatgtaattgaattctcactacagccctaggatgtacatattattaaccacttatataggtaagaaagctgaggctctgagaagtttagtaacttgtcaactgtcacccaactaaaaagtttcagagctgaggatttagacttagagctgtgtaacttcaatacacagactctatctacttcacaacctgcaatgtgattctgattcctttaattcctgttgtatgtactatgtcagctcaaacccctacccctgtccctgcccatacctccacccactcacctccctaacctccttatgtccctcgcagtagcaagatgtaggtgataggaaggacttcggtgtgagaattagaaatgatgtaaatgtttacgcaggagtgctgggataggagtcgggatggtgagggtagttagatttttgcctcacttgccctgaaagtggtaatagggagaaaccaatctgaattacaattacttaaatgtatcacagactgtcactttgtattcctccaacatgtttggtaacaagtgtttaatgtatgttaaaacaaagaaggtttttatacccttccattaaaatatgtcagtgggcccttccattttatggagtggaatgggaaggcccttgacagccaggaacca

SEQ ID NO: 121629 - DNA, 700 bp, Homo sapiens
  Payload ID: 3847
  Gene Symbol: COL28A1
  Gene Name: collagen, type XXVIII, alpha 1
  ENST ID: ENST00000453441
  CDS Start-End: 1-243
gccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtctaccctcattcaattcaacagtgcaaaaaagagcactcacggaagaaggagatggaagaatagccatcttggcagaaataatgatatgtataatttttttatttaattaaaattgtattatgtaatatttgatactacaaaagataatgcaacatgtttgtcaattttttttattatactttaagttttagggtacatgtgcacaaagtacaggtttgttacatatgtattcatgtgccatgttggtgtgctgcacccattaactcgtcatttaacattaggtatatttcctaatgctatccctccccactcccccgccaccccacaacaggccctggtgtgtgatgttccccttcctgtgtccatgtgttctcattgttcaactcccacctatgagtgagaacatgcggtgtttggttttttgtccttgtgacagtttgctgagaatga

SEQ ID NO: 121630 - DNA, 1755 bp, Homo sapiens
  Payload ID: 3847
  Gene Symbol: COL28A1
  Gene Name: collagen, type XXVIII, alpha 1
  ENST ID: ENST00000444268
  CDS Start-End: 1-204
aaaggaaacccgggcaacgctcaaaaaggagaagctggagaaagaggtccagggggaattcctgggtacaagggtgacaagcaatattctagggaagacagggaagtagagcataataatgaaaaatatgtagcatgcttgctgccaagcccggctctcctacagcagtcctcgctaactcatcatggcacctgttcccactaactcacgatgcaatctcacttcagaacctttctctcacggttctccaggtgaacactactaggtggtcaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaagtaagtgaatagggttgtgctggagtcacctctgatttcaccagagtgattgggagaagaggttgtagataacgcaaaaatggctattatgaaatagatttattgtgagcctcgcagttaaatggcatccagtgtttagagacatcatctggaagtgtaaaaatggtatgagtacaatacttcagcaaatgctaaacattatataaattgcttggtgcaaaagtgaa

SEQ ID NO: 121631 - DNA, 678 bp, Homo sapiens
  Payload ID: 3847
  Gene Symbol: COL28A1
  Gene Name: collagen, type XXVIII, alpha 1
  ENST ID: ENST00000435823
  CDS Start-End: 1-393
ggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagactttgaacacttcccatggccttgaagatccttcatgccccgactgcagcttctgtcatttctccctggctgccgacattcagccaaaatggcctgccctacttcagctcattcctgcatcagggactcgccaggatggctgattattaaaagcttagctcaaatgtcacctccccgaccacccatacagaaagcattactaccccaacccctctgtatgttttccatgtagcgtgtatcactttctgagatcatcttcctcatttatttctctgcatattccatgagagtgaaggttttcctggagcaggcttcttgctttgttccctcctaacttcatgtcaccagaactaggtgtaccattcagtaggagctctacaacttgttgaatgaatggaaaatgaataaatgatcaatattaccctaaa

SEQ ID NO: 121632 - DNA, 2323 bp, Homo sapiens
  Payload ID: 3847
  Gene Symbol: COL28A1
  Gene Name: collagen, type XXVIII, alpha 1
  ENST ID: ENST00000430711
  CDS Start-End: 1-429
tttgattcctatctcgttcaaatttttggttcatcgtcacctcaacctggatttgggatgtcaggggaagaactcagtgaatctactccagagcctcaaaaagaaatttctgagtcattgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtaaattggcctgtctctatcaaaagcatagaactccctaatttccacatattcacccaatacaaatacagcactatatttgagtgtatactgagtatttacaacttatacatgtaattgaattctcactacagccctaggatgtacatattattaaccacttatataggtaagaaagctgaggctctgagaagtttagtaacttgtcaactgtcacccaactaaaaagtttcagagctgaggatttagacttagagctgtgtaacttcaatacacagactctatctacttcacaacctgcaatgtgattctgattcctttaattcctgttgtatgtactatgtcagctcaaacccctacccctgtccctgcccatacctccacccactcacctccctaacctccttatgtccctcgcagtagcaagatgtaggtgataggaaggacttcggtgtgagaattagaaatgatgtaaatgtttacgcaggagtgctgggataggagtcgggatggtgagggtagttagatttttgcctcacttgccctgaaagtggtaatagggagaaaccaatctgaattacaattacttaaatgtatcacagactgtcactttgtattcctccaacatgtttggtaacaagtgtttaatgtatgttaaaacaaagaaggtttttatacccttccattaaaatatgtcagtgggcccttccattttatggagtggaatgggaaggcccttgacagccaggaaccacttgaagttggcatccactcttgaacagtgtgtattaaagacaggattcacactgaaaagtgagccaccaaattgaaatgcgagtaatggagagtaacggagaattgactctgtcattttataatacttttgcaagatcctgtctgggaagagcattagttctgagctgagttcagacagcacttgcatatttctttcttttttttttttttcccccagacagaatcttgctctgtcatccagcctgggtgacacagcaagactctgtctcaaaacaaaaacaaaaacaaaaaacaaaatactttctccttctatcaggtctaccctcattcaattcaacagtgcaaaaaagagcactcacggaagaaggagatggaagaatagccatcttggcagaaataatgatatgtataatttttttatttaattaaaattgtattatgtaatatttgatactacaaaagataatgcaacatgtttgtcaattttttttattatactttaagttttagggtacatgtgcacaaagtacaggtttgttacatatgtattcatgtgccatgttggtgtgctgcacccattaactcgtcatttaacattaggtatatttcctaatgctatccctccccactcccccgccaccccacaacaggccctggtgtgtgatgttccccttcctgtgtccatgtgttctcattgttcaactcccacctatgagtgagaacatgcggtgtttggttttttgtccttgtgacagtttgctgagaatgatggtttccagcttcatccatgtccctacaaaggacatgaactcatcattttttatggctgcatagtattctgtggtgtatatgtaacatgcttgtcaatttaaaaacatgataagatgaacaccagtgaacacatcacctagagaatgaagcaaacatcaaaaattctattgcagcttcccgtgtggccctccgccatcccagctctctattccatgccagggatatcccattttgaacttcgtatttaccatgtcaatgtgctgttgacatttataggtaattttacatgtaaaactctatatatctctatgtgttgccaaacaataaatatttagccttgcttattttacagttttacaaaaa

SEQ ID NO: 121633 - DNA, 2784 bp, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENST ID: ENST00000383781
  CDS Start-End: 286-1623
atatcctcccctgggctgaaggcactcttgtcctccaagcctcccctacagcagtgttcatgggcagctggagcagggctgcctacccattgctactcccaggagctcaggactggctccagacccctggcatctggagcagaagcaacatcaaagcagggattggccaactcccacccctaatgccaaacaggccaggcactgggagcactcagaggcgtgacgaatctcagcctgtctccggctagtgttccctggccagtccgctttgggccctgcctcacaatgacgggctcatcattcagcctcgctcatctgctcatcatttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaag

SEQ ID NO: 121634 - DNA, 1482 bp, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENST ID: ENST00000383786
  CDS Start-End: 112-1377
acacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtg

SEQ ID NO: 121635 - DNA, 3005 bp, Homo sapiens
  Payload ID: 3848
  Gene Symbol: COLQ
  Gene Name: collagen-like tail subunit (single strand of homotrimer)  of asymmetric acetylcholinesterase
  Uniprot ID: Q9Y215
  ENST ID: ENST00000383788
  CDS Start-End: 127-1494
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttcccca

SEQ ID NO: 121636 - DNA, 1668 bp, Homo sapiens
  Payload ID: 3848
  Gene Symbol: COLQ
  Gene Name: collagen-like tail subunit (single strand of homotrimer)  of asymmetric acetylcholinesterase
  ENST ID: ENST00000603808
  CDS Start-End: 127-1497
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgtgactgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaattta

SEQ ID NO: 121637 - DNA, 582 bp, Homo sapiens
  Payload ID: 3848
  Gene Symbol: COLQ
  Gene Name: collagen-like tail subunit (single strand of homotrimer)  of asymmetric acetylcholinesterase
  ENST ID: ENST00000605797
  CDS Start-End: 1-582
atttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccacca

SEQ ID NO: 121638 - DNA, 3146 bp, Homo sapiens
  Payload ID: 3849
  Gene Symbol: CRMP1
  Gene Name: collapsin response mediator protein 1
  Uniprot ID: Q14194
  ENST ID: ENST00000324989
  CDS Start-End: 90-2150
gcaccgaggcgcggagcgcggcgcacggcggtgcccagggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggcggcatgttcgccgcggtggagggcgcctacgagaacaagaccatcgacttcgacgcctacagtgtgggccgccgcggctcggcgcgcacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttca

SEQ ID NO: 121639 - DNA, 2911 bp, Homo sapiens
  Payload ID: 3849
  Gene Symbol: CRMP1
  Gene Name: collapsin response mediator protein 1
  Uniprot ID: Q14194
  ENST ID: ENST00000397890
  CDS Start-End: 216-1934
ccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 121640 - DNA, 2764 bp, Homo sapiens
  Payload ID: 3849
  Gene Symbol: CRMP1
  Gene Name: collapsin response mediator protein 1
  ENST ID: ENST00000512574
  CDS Start-End: 535-2247
ctggtacggggaacctaggacttaacaactccaaggaagggagtgtaggagttggggagggacagtgtccccatctgcaatttccggtcattgacagggattttaggccccgctgagagccagggatgcatgaatgcgtggagggaaatgagttgtaaacagagtgtaggggaacctggcatctccatgctgctttgctgcagctaatatgttttgcacccggggtacatcattttacctctgtaagcctcaatttcctgtctgtaaaatgggaaaattatgcctagtgttcctgggatactgagctggcttctctgtgaagctaaaacctcacctctattttaaggcccaggtgtctctggcctcctgccctggattaggggactggcccctggggtggtgaaggtcagggccccagcccccaaccacagtgctgggggagctgtaccaagcctaggccaccctcgctctggatggcaacttgaaagcagaaaagatgagtagtttcataggacctgtggggttggatttcgcatgcagaaaatgaacaacgaagtggtggacaagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccac

SEQ ID NO: 121641 - DNA, 1266 bp, Homo sapiens
  Payload ID: 3850
  Gene Symbol: COLEC10
  Gene Name: collectin sub-family member 10 (C-type lectin)
  Uniprot ID: Q9Y6Z7
  ENST ID: ENST00000332843
  CDS Start-End: 42-875
tttggcatttctgggagacccttttctgaggaaccacagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcatgctcttttgtgatgattttcatattttcacacatggtatattattgacccaataactcgccaggttacatgggtcttgagagagaattttaattactaattgtgcacgagatagttggttgtctatatgtcaaatgagttgttctcttggtatttgctctaccatctctccctagagcactctgtgtctatcccagtggataatttcccagtttactggtgatgattaggaaggttgttgatgg

SEQ ID NO: 121642 - DNA, 1381 bp, Homo sapiens
  Payload ID: 3851
  Gene Symbol: COLEC11
  Gene Name: collectin sub-family member 11
  Uniprot ID: Q9BWP8
  ENST ID: ENST00000236693
  CDS Start-End: 235-1041
cttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaa

SEQ ID NO: 121643 - DNA, 1259 bp, Homo sapiens
  Payload ID: 3851
  Gene Symbol: COLEC11
  Gene Name: collectin sub-family member 11
  Uniprot ID: Q9BWP8
  ENST ID: ENST00000349077
  CDS Start-End: 104-919
gccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaa

SEQ ID NO: 121644 - DNA, 1633 bp, Homo sapiens
  Payload ID: 3851
  Gene Symbol: COLEC11
  Gene Name: collectin sub-family member 11
  Uniprot ID: Q9BWP8
  ENST ID: ENST00000382062
  CDS Start-End: 364-1107
aaaaaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaacttta

SEQ ID NO: 121645 - DNA, 1134 bp, Homo sapiens
  Payload ID: 3851
  Gene Symbol: COLEC11
  Gene Name: collectin sub-family member 11
  Uniprot ID: Q9BWP8
  ENST ID: ENST00000402794
  CDS Start-End: 141-806
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 121646 - DNA, 1557 bp, Homo sapiens
  Payload ID: 3851
  Gene Symbol: COLEC11
  Gene Name: collectin sub-family member 11
  Uniprot ID: Q9BWP8
  ENST ID: ENST00000403096
  CDS Start-End: 492-1229
tgcggctctttttattgaaacattagagaaaagtagattcaaacccatgatcaaaacagtcaccacgaaagacaaaccctgctcagcccgtgttgtacaaaatgaaaaggtcagccctctcccggggcacagggtccggacagctcggggccaccctgccaggctgtgcagctctggctgggggcttttttccggctgtgttagccctgctgttggaaaccaagtggactgtcctgcagcccagacaagcccagtggcctttgtgcttttaattgtgataaatgtacctgctttagaaaatgtttaattatgttggaagcaacttaaactgttggatgcctacggctctctcagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 121647 - DNA, 1134 bp, Homo sapiens
  Payload ID: 3851
  Gene Symbol: COLEC11
  Gene Name: collectin sub-family member 11
  Uniprot ID: Q9BWP8
  ENST ID: ENST00000402922
  CDS Start-End: 141-806
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggggatgcgggagagaagggagacaaaggcgcccccggacggcctggaagagtcggccccacgggagaaaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 121648 - DNA, 1062 bp, Homo sapiens
  Payload ID: 3851
  Gene Symbol: COLEC11
  Gene Name: collectin sub-family member 11
  Uniprot ID: Q9BWP8
  ENST ID: ENST00000404205
  CDS Start-End: 141-734
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 121649 - DNA, 581 bp, Homo sapiens
  Payload ID: 3851
  Gene Symbol: COLEC11
  Gene Name: collectin sub-family member 11
  ENST ID: ENST00000438814
  CDS Start-End: 212-581
agatttgggagaaggatttcaaatgacttcccttcgagctgcagggctatcttgggcatcttgacctccacacatttctgggagaactcctcgtgcagcaggacatcaggtggcaaaggtgatctgcccacctcagcctcccaaagtgctggaattacaggtgtgagccactgcgcctggtcttgttttccaagttgtaacgcccttcacgatgaagaaacaaagaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccag

SEQ ID NO: 121650 - DNA, 1378 bp, Homo sapiens
  Payload ID: 3851
  Gene Symbol: COLEC11
  Gene Name: collectin sub-family member 11
  ENST ID: ENST00000416132
  CDS Start-End: 42-392
ctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccagctccttcggcaccgcagagatgaggaggaacggctgcttggaaggtgtgcttgccggtgtgacttggctgagtgtgagtgcgctgagatcagtgtcactgactggccgagcagcatccgctcagggcacctccaggcactcagccaacctgaggggcccggacaaagcctctgggagacagaaggacctggaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 121651 - DNA, 1595 bp, Homo sapiens
  Payload ID: 3851
  Gene Symbol: COLEC11
  Gene Name: collectin sub-family member 11
  Uniprot ID: Q9BWP8
  ENST ID: ENST00000418971
  CDS Start-End: 212-1069
agatttgggagaaggatttcaaatgacttcccttcgagctgcagggctatcttgggcatcttgacctccacacatttctgggagaactcctcgtgcagcaggacatcaggtggcaaaggtgatctgcccacctcagcctcccaaagtgctggaattacaggtgtgagccactgcgcctggtcttgttttccaagttgtaacgcccttcacgatgaagaaacaaagaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaacttta

SEQ ID NO: 121652 - DNA, 5742 bp, Homo sapiens
  Payload ID: 3852
  Gene Symbol: COLEC12
  Gene Name: collectin sub-family member 12
  Uniprot ID: Q5KU26
  ENST ID: ENST00000400256
  CDS Start-End: 209-2437
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggctccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccagcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtgtatatatatatatatatatatatttttttttttttttttttttaatgtttcatttcctcagaggaaccaatcacttggaatgtctagaaatatccttgcagattttgccagtgtcaatcaagcctgcacacatgcacagtgaagcgggctgtgcctgccttgagcccatcaccagccaacattcttgacgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtatggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcactttgggaggccgaggcaggcagatgacttgaggtcaggagttcgagaccagcctggccaacgtggcaaaaccccatctctactaaaaataagaaaattagccgggtgtagtggcacatgcctgtaatcccagctactcaggaggctgaggcaggagaatcgcttgagcccaggaggcagagattgcagtgagccaagatcgcaccactgcactccagcctcggtgacagagcaagactccatctcaaaaaaaaaaaaaaaaaaaaaacctttcctctgagcccatcttcctttcgctccttgactttccttgacttgctgttggaaagtctaatatgaaaagggctgaaactaggcattaaatataactgatgctcaaaggtaagatttccatccaacagattccttctccctcccaagggtcttcccaggcagtgctgctacttatcccaaataaaatggtaaaagaataaagacagccgggcgcggtggctcacgcctgtaatcccagcactttgggaggccgaggcggacggatcacaaggtcaggagatcgagaccatcctggctaacacggtgaaaccccgtctctactaaaaatacaaaaaaaaaattagccgggcgcggtggcgggcgcctgtagtcccagctactcgggaggctgaggcaggagaatggcgtgaacccaggaagcggagcttgcagtgagccgagatcgcgccactgcactccagcctgggcgacagagcgagactcatctcaaaaagaaaaaaaaaaaagaataaagacagagtttgactttcccacctgcgaacaagtggactgtactgctttgcccacagtctccattccccattcatgctgttttcacagcccagtaatggccaactgctcagcacctgtgtgccctgctgtcaggcaggtgggacccacagtcctctgggcctaaactgctgaagcctgcaccacaaggcgggcacggcattccaacacctcttcaggctcaacagcctttagaggctacactgagtcctctttttcatgctcttcctggttttcaagtgtcaattaaaatttgtcttcagaagaaacttgaaaataagtatctgatgccgtcatcaggatagactagtattagctttcgcagctgaagttattgctctcccagccctaataataacttaccaagtgcttattatttatcaggcactggtccaagtccttcaatcagattgtctcacctgatcctcccaacagccctaggaagcaggtcttactacactccccatttcacagggactggggcttggggaggtgatgcggtttcctgggtcactccattactgagtagtgagacaggattcagacgcaagctttgaaaatgttctaattttctttagaaggaagggcccttcttaatagcacactgaataaaatcaaatgaataatcacacattacaagatgcctcctatacgtctctatatttagctacttacataccaggtttcttttttgtttgtttttgtttttaagacagagtctcgctctgtcacccaggctggagtgcggtggcgcgatctcggctcactgcaatctctgcctcccaggttcaagcgactctcccgcctcagcctctgcagtagcttagggactacaggtgcgtgccaccatgccaggctaatttttgtgtttttagtagagacacggtttcgccattttggccaggctggtctcaaactcctgacctcaggtgatccacccgccttggcctcccaaagtgctgggattacaggtgtgagccaccgtgcccggcctacacaccagctttctattcacctacacacaactgatgctcttttggagtggagagttttagtaaaatatgatggggtcttcaggcacctgagttgctacttactactatgagaagatagaaaatgttttttcctctaaacagcttttgaaagaatgaatgcacaacaaggcaaaaaataaaaactttcttttccttttcta

SEQ ID NO: 121653 - DNA, 4210 bp, Homo sapiens
  Payload ID: 3853
  Gene Symbol: CSF1
  Gene Name: colony stimulating factor 1 (macrophage)
  Uniprot ID: P09603
  ENST ID: ENST00000329608
  CDS Start-End: 392-2056
gtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgaacaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgc

SEQ ID NO: 121654 - DNA, 597 bp, Homo sapiens
  Payload ID: 3853
  Gene Symbol: CSF1
  Gene Name: colony stimulating factor 1 (macrophage)
  ENST ID: ENST00000357302
  CDS Start-End: 240-597
cttggaagtgcagcgcagaagacagaggtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctga

SEQ ID NO: 121655 - DNA, 1364 bp, Homo sapiens
  Payload ID: 3853
  Gene Symbol: CSF1
  Gene Name: colony stimulating factor 1 (macrophage)
  Uniprot ID: P09603
  ENST ID: ENST00000369801
  CDS Start-End: 39-1355
gggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattc

SEQ ID NO: 121656 - DNA, 2484 bp, Homo sapiens
  Payload ID: 3853
  Gene Symbol: CSF1
  Gene Name: colony stimulating factor 1 (macrophage)
  Uniprot ID: P09603
  ENST ID: ENST00000369802
  CDS Start-End: 126-1790
gagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgctcctcctgctcttttgtatttggctaatagtatatcaatttgcactt

SEQ ID NO: 121657 - DNA, 1083 bp, Homo sapiens
  Payload ID: 3853
  Gene Symbol: CSF1
  Gene Name: colony stimulating factor 1 (macrophage)
  Uniprot ID: P09603
  ENST ID: ENST00000420111
  CDS Start-End: 117-887
tccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgag

SEQ ID NO: 121658 - DNA, 551 bp, Homo sapiens
  Payload ID: 3853
  Gene Symbol: CSF1
  Gene Name: colony stimulating factor 1 (macrophage)
  ENST ID: ENST00000525659
  CDS Start-End: 212-551
gaatcagcctggagagcgcggaaggaaagggtcggtccgcagagggcgcggggaaggcagggtggggacgcggtggagcccgcgctcgtttgctgaaggcttggaagtgcagcgcagaagacagaggacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatg

SEQ ID NO: 121659 - DNA, 1009 bp, Homo sapiens
  Payload ID: 3853
  Gene Symbol: CSF1
  Gene Name: colony stimulating factor 1 (macrophage)
  ENST ID: ENST00000488198
  CDS Start-End: 155-1009
gaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctcc

SEQ ID NO: 121660 - DNA, 577 bp, Homo sapiens
  Payload ID: 3853
  Gene Symbol: CSF1
  Gene Name: colony stimulating factor 1 (macrophage)
  ENST ID: ENST00000527192
  CDS Start-End: 127-577
gaatgggacttgaagctggccgggctgcttgggggctgcagaggaagaagggggctgccggcaaacctgctgactcaggctccacgagggagcaagtaacactggactcctttcggcactccgagaatggggtgggggcgtcttcaaaggatttccctcccttcccagtgcttgtccctgctctcgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctcc

SEQ ID NO: 121661 - DNA, 3989 bp, Homo sapiens
  Payload ID: 3854
  Gene Symbol: CSF1R
  Gene Name: colony stimulating factor 1 receptor
  Uniprot ID: P07333
  ENST ID: ENST00000286301
  CDS Start-End: 293-3211
gaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 121662 - DNA, 655 bp, Homo sapiens
  Payload ID: 3854
  Gene Symbol: CSF1R
  Gene Name: colony stimulating factor 1 receptor
  ENST ID: ENST00000511344
  CDS Start-End: 508-655
gaagggcagacagagtgtccaaaagcgtgagagcacgaagtgaggagaaggtggagaagagagaagaggaagaggaagaggaagagaggaagcggagggaactgcggccagggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaag

SEQ ID NO: 121663 - DNA, 3697 bp, Homo sapiens
  Payload ID: 3854
  Gene Symbol: CSF1R
  Gene Name: colony stimulating factor 1 receptor
  ENST ID: ENST00000504875
  CDS Start-End: 164-2179
ggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 121664 - DNA, 723 bp, Homo sapiens
  Payload ID: 3854
  Gene Symbol: CSF1R
  Gene Name: colony stimulating factor 1 receptor
  ENST ID: ENST00000515068
  CDS Start-End: 1-195
gcagggagcccatgggcccttggacagaggccctttggtgcccagggacttaagggacctgtgtgcgtggcagccacggcccatgctgatgagaaggaggccctcatgtccgagctgaagatcatgagccacctgggccagcacgagaacatcgtcaaccttctgggagcctgtacccatggaggcatctcttgaggactgttggaagtgcaccacctcaggcccatccacccaggcctgctgattcaaaatctgcattgcagagattcccggggtgatttatctgcacatgagttgcagcggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttg

SEQ ID NO: 121665 - DNA, 921 bp, Homo sapiens
  Payload ID: 3854
  Gene Symbol: CSF1R
  Gene Name: colony stimulating factor 1 receptor
  Uniprot ID: P07333
  ENST ID: ENST00000543093
  CDS Start-End: 1-921
atgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtaggcacaccttcaccctctctctgccccgcctga

SEQ ID NO: 121666 - DNA, 787 bp, Homo sapiens
  Payload ID: 3855
  Gene Symbol: CSF2
  Gene Name: colony stimulating factor 2 (granulocyte-macrophage)
  Uniprot ID: P04141
  ENST ID: ENST00000296871
  CDS Start-End: 35-469
gtacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttctacttg

SEQ ID NO: 121667 - DNA, 1628 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000355432
  CDS Start-End: 150-1283
agcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttgatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 121668 - DNA, 1410 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000355805
  CDS Start-End: 150-851
agcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 121669 - DNA, 1283 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000381500
  CDS Start-End: 19-1020
ttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccag

SEQ ID NO: 121670 - DNA, 1601 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000381509
  CDS Start-End: 163-1395
ccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctggg

SEQ ID NO: 121671 - DNA, 2291 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000381524
  CDS Start-End: 187-1389
ggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggcgccgtggctcatgcctgtaatcctaacactttggaggattgctggagacaggagtttaagaccagtctgggcaacatagcaagaccctgtctctacaaaaaaggcaaaaattagctgggcgtggtggcttgtgcctgtagtgccagctatctgggaggctgaggcgggaggatcacttgagttcaagctgacagtaagctatgattgcaccgttgcactccagcctgggtaacaaactaagaccccatctctctgtctcaaaaaaagtgatacttcgcaaagatgcttagactccaagaagcttttgcatctctttccaacccaactactgaggtactgtgtagcctcctccttgaataactaacctggtgagctgagattgcgccattgcaatccagcctgggcaacaagagcaaaactccatcacatttaaaaaaaaaaaaaaa

SEQ ID NO: 121672 - DNA, 1816 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000381529
  CDS Start-End: 171-1373
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctga

SEQ ID NO: 121673 - DNA, 1955 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000417535
  CDS Start-End: 195-1499
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttgggtctcactctgtcacccaggctggagtgcaatggcacaatctcggctcactgcaacctccgtctcccaggctcaagcgattctcctgcctcagactcccaggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 121674 - DNA, 856 bp, Homo sapiens
  Payload ID: 3856
  Gene Symbol: CSF2RA
  Gene Name: colony stimulating factor 2 receptor, alpha, low-affinity (granulocyte-macrophage)
  ENST ID: ENST00000419094
  CDS Start-End: 293-856
ctccgagagaagaaaagcaggtggaaggagaggaagcggatgccgtggggtttacagcaggaaaatccgtggagacagcagatccgagaagcggcgatgtttgcgtagaaccctgtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccagctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtct

SEQ ID NO: 121675 - DNA, 802 bp, Homo sapiens
  Payload ID: 3856
  Gene Symbol: CSF2RA
  Gene Name: colony stimulating factor 2 receptor, alpha, low-affinity (granulocyte-macrophage)
  ENST ID: ENST00000412290
  CDS Start-End: 89-802
agaagcgggagtctccgagagaagaaaagcaggtggaaggagaggaagcggatgccgtggggctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaa

SEQ ID NO: 121676 - DNA, 1981 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000432318
  CDS Start-End: 323-1525
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccagctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 121677 - DNA, 1671 bp, Homo sapiens
  Payload ID: 3856
  Gene Symbol: CSF2RA
  Gene Name: colony stimulating factor 2 receptor, alpha, low-affinity (granulocyte-macrophage)
  ENST ID: ENST00000486791
  CDS Start-End: 150-1007
agcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 121678 - DNA, 1622 bp, Homo sapiens
  Payload ID: 3856
  Gene Symbol: CSF2RA
  Gene Name: colony stimulating factor 2 receptor, alpha, low-affinity (granulocyte-macrophage)
  Uniprot ID: P15509
  ENST ID: ENST00000501036
  CDS Start-End: 363-1166
ctctgaagggagctactcagaagcgggagtctccgagagaagaaaagcaggtggaaggagaggaagcggatgccgtggggctcttcccttctctctgaccagcaccatgcttctcctggtgacaagccttctgctctgtgagttaccacacccagcattcctcctgatcccagagaaatcggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 121679 - DNA, 489 bp, Homo sapiens
  Payload ID: 3856
  Gene Symbol: CSF2RA
  Gene Name: colony stimulating factor 2 receptor, alpha, low-affinity (granulocyte-macrophage)
  ENST ID: ENST00000494969
  CDS Start-End: 163-435
ccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggatggagtttccctcttgttgcccagatcgcaccattgcacaccaacctgcgtgacagagcaagattgcatctcaaaacaaacaataataataaataataaaaacctga

SEQ ID NO: 121680 - DNA, 4087 bp, Homo sapiens
  Payload ID: 3857
  Gene Symbol: CSF2RB
  Gene Name: colony stimulating factor 2 receptor, beta, low-affinity (granulocyte-macrophage)
  ENST ID: ENST00000262825
  CDS Start-End: 218-2887
gcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaac

SEQ ID NO: 121681 - DNA, 4863 bp, Homo sapiens
  Payload ID: 3857
  Gene Symbol: CSF2RB
  Gene Name: colony stimulating factor 2 receptor, beta, low-affinity (granulocyte-macrophage)
  Uniprot ID: P32927
  ENST ID: ENST00000403662
  CDS Start-End: 223-2916
actctgcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaa

SEQ ID NO: 121682 - DNA, 2895 bp, Homo sapiens
  Payload ID: 3857
  Gene Symbol: CSF2RB
  Gene Name: colony stimulating factor 2 receptor, beta, low-affinity (granulocyte-macrophage)
  Uniprot ID: P32927
  ENST ID: ENST00000406230
  CDS Start-End: 75-2786
actaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtag

SEQ ID NO: 121683 - DNA, 969 bp, Homo sapiens
  Payload ID: 3857
  Gene Symbol: CSF2RB
  Gene Name: colony stimulating factor 2 receptor, beta, low-affinity (granulocyte-macrophage)
  ENST ID: ENST00000421539
  CDS Start-End: 284-969
ggttcccacctccgggactttgctcctgcagggccttggctggggttctctccctgcttcagccgctagcaccctccttgtgcctgaagcccgcactgggatgctcctgggctcttgagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcc

SEQ ID NO: 121684 - DNA, 1509 bp, Homo sapiens
  Payload ID: 3858
  Gene Symbol: CSF3
  Gene Name: colony stimulating factor 3 (granulocyte)
  Uniprot ID: P09919
  ENST ID: ENST00000225474
  CDS Start-End: 32-655
cggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 121685 - DNA, 1673 bp, Homo sapiens
  Payload ID: 3858
  Gene Symbol: CSF3
  Gene Name: colony stimulating factor 3 (granulocyte)
  ENST ID: ENST00000331769
  CDS Start-End: 217-819
agcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 121686 - DNA, 622 bp, Homo sapiens
  Payload ID: 3858
  Gene Symbol: CSF3
  Gene Name: colony stimulating factor 3 (granulocyte)
  Uniprot ID: P09919
  ENST ID: ENST00000394148
  CDS Start-End: 9-524
ccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccag

SEQ ID NO: 121687 - DNA, 1583 bp, Homo sapiens
  Payload ID: 3858
  Gene Symbol: CSF3
  Gene Name: colony stimulating factor 3 (granulocyte)
  Uniprot ID: P09919
  ENST ID: ENST00000394149
  CDS Start-End: 115-729
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 121688 - DNA, 1360 bp, Homo sapiens
  Payload ID: 3858
  Gene Symbol: CSF3
  Gene Name: colony stimulating factor 3 (granulocyte)
  ENST ID: ENST00000577675
  CDS Start-End: 177-671
gccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctgga

SEQ ID NO: 121689 - DNA, 1288 bp, Homo sapiens
  Payload ID: 3858
  Gene Symbol: CSF3
  Gene Name: colony stimulating factor 3 (granulocyte)
  ENST ID: ENST00000579852
  CDS Start-End: 30-203
gagcctgcagcccagccccacccagacccatggctggacctgccacccagagccccatgaagctgatggtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgt

SEQ ID NO: 121690 - DNA, 579 bp, Homo sapiens
  Payload ID: 3858
  Gene Symbol: CSF3
  Gene Name: colony stimulating factor 3 (granulocyte)
  ENST ID: ENST00000583218
  CDS Start-End: 115-579
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctg

SEQ ID NO: 121691 - DNA, 2375 bp, Homo sapiens
  Payload ID: 3859
  Gene Symbol: CSF3R
  Gene Name: colony stimulating factor 3 receptor (granulocyte)
  Uniprot ID: Q99062
  ENST ID: ENST00000331941
  CDS Start-End: 24-2375
caggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggctgggcctcccaggcgatctgcatactttaaggaccagatcatgctccatccagccccacccaatggccttttgtgcttgtttcctataacttcagtattgtaa

SEQ ID NO: 121692 - DNA, 2847 bp, Homo sapiens
  Payload ID: 3859
  Gene Symbol: CSF3R
  Gene Name: colony stimulating factor 3 receptor (granulocyte)
  Uniprot ID: Q99062
  ENST ID: ENST00000361632
  CDS Start-End: 24-2534
caggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgt

SEQ ID NO: 121693 - DNA, 3454 bp, Homo sapiens
  Payload ID: 3859
  Gene Symbol: CSF3R
  Gene Name: colony stimulating factor 3 receptor (granulocyte)
  Uniprot ID: Q99062
  ENST ID: ENST00000373103
  CDS Start-End: 549-3140
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggagctgcccggacccagacagggacagtggctggggcagacatctgaaatgagccgtgctctcaccccacatccttgtgtgcaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 121694 - DNA, 2953 bp, Homo sapiens
  Payload ID: 3859
  Gene Symbol: CSF3R
  Gene Name: colony stimulating factor 3 receptor (granulocyte)
  Uniprot ID: Q99062
  ENST ID: ENST00000373104
  CDS Start-End: 549-2900
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 121695 - DNA, 3373 bp, Homo sapiens
  Payload ID: 3859
  Gene Symbol: CSF3R
  Gene Name: colony stimulating factor 3 receptor (granulocyte)
  Uniprot ID: Q99062
  ENST ID: ENST00000373106
  CDS Start-End: 549-3059
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 121696 - DNA, 512 bp, Homo sapiens
  Payload ID: 3859
  Gene Symbol: CSF3R
  Gene Name: colony stimulating factor 3 receptor (granulocyte)
  ENST ID: ENST00000533491
  CDS Start-End: 448-512
gagagtagaaacagcaagggagcgaggggtgtgaagtggggaagagagtgtgaggggagagggctgagcgtgatgagggagaaacagaaagagggaatgtgaaggcagccagcccaggagacatcgagctgtgctgggccacaggagtgagcacctgcagagcccagcagagatggccgcagtgacaggagggccagggggcccaggagttaggaggagaggatccagaaagggggctttggaactgcgcagtgtggcacagacaaaagcaagatggggaaactgaggctcggctcggaaaggtgaagtaacttgtccaagatcacaaagctgggataaattgaccctccagtggacagctctgagaagtgttctacatggctctttggaaggttccagcaggatagagccccagttgtccatagaggtgaacatcaagttggtgctatggcaaggctgggaaactgcagcctgacttgggctgccctgatcatcctgctgctccccggaag

SEQ ID NO: 121697 - DNA, 1440 bp, Homo sapiens
  Payload ID: 3859
  Gene Symbol: CSF3R
  Gene Name: colony stimulating factor 3 receptor (granulocyte)
  ENST ID: ENST00000464465
  CDS Start-End: 1-1166
ggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggt

SEQ ID NO: 121698 - DNA, 1414 bp, Homo sapiens
  Payload ID: 3860
  Gene Symbol: COLCA2
  Gene Name: colorectal cancer associated 2
  Uniprot ID: A8K830
  ENST ID: ENST00000398035
  CDS Start-End: 759-1223
actatctccaggcgtccaggctgaacgcgcggtcaccctcggccgccgcacccagcgcacttcccggcgcgattcctggacgcacactgcagggtagtggtcagggccggagccgccccggactcctgcggccacctccaccttgaaagctcgcccggctcggcttggcctaacagccagtccccaacctactcactgcggcttttcggggcccggggctgaggctgcccctgctcccagcgctcaggggtccctcccagcgaacccctcttgagcgcgcccgccacctcccgcgagccggggcagtccgaccgggccccgccagccccggggcggcccctaccgaagggcggcctcccggcggagtgcagggtcatcgggagccccggacggctttccccagctcgcgctgcgcggactcgccccggagcctcagtgcgcctcggagaaacgcctgccccagaaagggaggggaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttg

SEQ ID NO: 121699 - DNA, 1332 bp, Homo sapiens
  Payload ID: 3860
  Gene Symbol: COLCA2
  Gene Name: colorectal cancer associated 2
  Uniprot ID: A8K830
  ENST ID: ENST00000526216
  CDS Start-End: 570-1034
agaggggaagaaggggagagtaggagcgggggcgaaggagggaggagggcaagatggagcgcggaaaaggcggagaaaagggacgagggagagcgggcagaaggcaaagacagaagggagcgagggagggagttcctcgggcctggcccctttactaggtcagtctggcaggtacctcgccggcccaggacggggctggccaaacctcaccgcttgctcccgggctggcttccagaccaagggcacgcagaggtcggagcctgcccagaagccacacctggccagaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttgtatgctcatagtttaaatttttgtaggaaactttcaattgttttactttttgtataacgaacaaatgctgtctccttttttactaataaataattttgtattactaa

SEQ ID NO: 121700 - DNA, 823 bp, Homo sapiens
  Payload ID: 3860
  Gene Symbol: COLCA2
  Gene Name: colorectal cancer associated 2
  ENST ID: ENST00000528846
  CDS Start-End: 504-823
tcccacgtatccactgttgtgtcctgagacacgcggtgcggaccctgcgcgcccagaagctgctacggggggagctagaggctcacagtgagcctgggacgggggcagagcgcaccgactgcactgagccgagctgtggcggtccctgcgcggaccccgaggggcgcccgctgcccgcggagtccggagccgatcggggaacggggtggtggggctgcgaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgc

SEQ ID NO: 121701 - DNA, 1264 bp, Homo sapiens
  Payload ID: 3860
  Gene Symbol: COLCA2
  Gene Name: colorectal cancer associated 2
  Uniprot ID: A8K830
  ENST ID: ENST00000614153
  CDS Start-End: 504-968
tcccacgtatccactgttgtgtcctgagacacgcggtgcggaccctgcgcgcccagaagctgctacggggggagctagaggctcacagtgagcctgggacgggggcagagcgcaccgactgcactgagccgagctgtggcggtccctgcgcggaccccgaggggcgcccgctgcccgcggagtccggagccgatcggggaacggggtggtggggctgcgaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttgtatgctcatagtttaaatttttgtaggaaactttcaattgttttactttttgtataacgaacaaatgctgtctccttttttactaataaataattttgtattact

SEQ ID NO: 121702 - DNA, 1088 bp, Homo sapiens
  Payload ID: 3860
  Gene Symbol: COLCA2
  Gene Name: colorectal cancer associated 2
  Uniprot ID: A8K830
  ENST ID: ENST00000610738
  CDS Start-End: 37-792
agcatccagccaccgacccagctcctgctgaccacgatgtcggaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttgtatgctcatagtttaaatttttgtaggaaactttcaattgttttactttttgtataacgaacaaatgctgtctccttttttactaataaataattttgtattact

SEQ ID NO: 121703 - DNA, 1469 bp, Homo sapiens
  Payload ID: 3861
  Gene Symbol: COMMD10
  Gene Name: COMM domain containing 10
  Uniprot ID: Q9Y6G5
  ENST ID: ENST00000274458
  CDS Start-End: 63-671
gcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagaccgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagga

SEQ ID NO: 121704 - DNA, 870 bp, Homo sapiens
  Payload ID: 3861
  Gene Symbol: COMMD10
  Gene Name: COMM domain containing 10
  ENST ID: ENST00000507356
  CDS Start-End: 38-457
gcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctctagagaccgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacac

SEQ ID NO: 121705 - DNA, 793 bp, Homo sapiens
  Payload ID: 3861
  Gene Symbol: COMMD10
  Gene Name: COMM domain containing 10
  ENST ID: ENST00000506589
  CDS Start-End: 1-366
gctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatag

SEQ ID NO: 121706 - DNA, 869 bp, Homo sapiens
  Payload ID: 3861
  Gene Symbol: COMMD10
  Gene Name: COMM domain containing 10
  ENST ID: ENST00000515539
  CDS Start-End: 135-701
gacactctggtgggaaaggctcacgctgctgctggagggtctttaatagccaacatgtgttaataccccttttaaatcagtatcgaataggggaccgaatttttggttggtagaagaatctagcctggctttgcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagaccgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaaga

SEQ ID NO: 121707 - DNA, 1433 bp, Homo sapiens
  Payload ID: 3861
  Gene Symbol: COMMD10
  Gene Name: COMM domain containing 10
  ENST ID: ENST00000632434
  CDS Start-End: 70-636
gacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagaccgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagg

SEQ ID NO: 121708 - DNA, 885 bp, Homo sapiens
  Payload ID: 3862
  Gene Symbol: COMMD2
  Gene Name: COMM domain containing 2
  ENST ID: ENST00000491617
  CDS Start-End: 29-436
tgccgggtgaaatcgtaggacagtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagatgtagaaaagtgcacaggtcaatgtaccgctcaatgaattatcacatggtgcatttaactgtgactcacaccccagaagcatcctccttgcctcctaattactgccccttcactcctttctaaagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaaga

SEQ ID NO: 121709 - DNA, 632 bp, Homo sapiens
  Payload ID: 3862
  Gene Symbol: COMMD2
  Gene Name: COMM domain containing 2
  ENST ID: ENST00000483708
  CDS Start-End: 7-372
gtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatggtaagggattttctggactgttttgtgttggctggattcttaagaacggtctggtgtactctacatcatagtcctggcagatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagca

SEQ ID NO: 121710 - DNA, 3706 bp, Homo sapiens
  Payload ID: 3862
  Gene Symbol: COMMD2
  Gene Name: COMM domain containing 2
  Uniprot ID: Q86X83
  ENST ID: ENST00000473414
  CDS Start-End: 56-655
cggaagtggcgaaggcggggtcggcgctgccgggtgaaatcgtaggacagtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagt

SEQ ID NO: 121711 - DNA, 1342 bp, Homo sapiens
  Payload ID: 3863
  Gene Symbol: COMMD3
  Gene Name: COMM domain containing 3
  Uniprot ID: Q9UBI1
  ENST ID: ENST00000376836
  CDS Start-End: 445-1032
gagatcggagcttcccgcaggattcgcgcagagcgaggagcggggaggacgccgtttgcgggaggcgggggccgggatcccgacaccgtccgcagtctccccggggtctctcagggaaccgagctggtggccgtccgaggtaagcgccgaaccaaggagaaagcgccgagcgcgtccacaaaacgcccgaggccgcccttctcgccaaggctcggcagctcccgcggcctgcgctggacaagcgagagctggacggaaacggtgggaggccgtaggcggcggctgggggcgcgggacccgcgcgcgggcgcggaggcgggcggggaggccccgcagcccgcgccgccgccagccgccccgagccgcgtgcgcgcgcggccgcatcagctgagcgcgcggcgcgtgtcacgtggtgtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaga

SEQ ID NO: 121712 - DNA, 757 bp, Homo sapiens
  Payload ID: 3863
  Gene Symbol: COMMD3
  Gene Name: COMM domain containing 3
  ENST ID: ENST00000448361
  CDS Start-End: 1-449
ggcttccagatgctggcggatccccgctccttcgactccaacgccttcacgcttctcctccgggcggcattccagagtctgctggacgcccaggcggacgaggccgtgttagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 121713 - DNA, 748 bp, Homo sapiens
  Payload ID: 3863
  Gene Symbol: COMMD3
  Gene Name: COMM domain containing 3
  ENST ID: ENST00000456711
  CDS Start-End: 1-490
aatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaag

SEQ ID NO: 121714 - DNA, 757 bp, Homo sapiens
  Payload ID: 3863
  Gene Symbol: COMMD3
  Gene Name: COMM domain containing 3
  ENST ID: ENST00000444869
  CDS Start-End: 1-532
ggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaata

SEQ ID NO: 121715 - DNA, 428 bp, Homo sapiens
  Payload ID: 3863
  Gene Symbol: COMMD3
  Gene Name: COMM domain containing 3
  ENST ID: ENST00000472610
  CDS Start-End: 1-146
cggagtctgtgcagaaaggcttccagatgctggcggatccccgctccttcgactccaacgccttcacgcttctcctccgggcggcattccagagtctgctggacgcccaggcggacgaggccgtgttaggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaag

SEQ ID NO: 121716 - DNA, 476 bp, Homo sapiens
  Payload ID: 3863
  Gene Symbol: COMMD3
  Gene Name: COMM domain containing 3
  ENST ID: ENST00000471350
  CDS Start-End: 1-225
aataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggtacagtattaggatctataaatattcctgtctttttataaatgtttacttgagagttatactcttgggaagttcaaaagaaaattaatctaaccatttgtcagcagataatgaagattggttaaggatttaatgggaaaggggcatcaaaagtagtattttaagataggcttcacttgaaattaagatgttattaatagagaattggtctgtatttgctgttcttgctgattgaaataaacttctgtagtgtttagtgtaaa

SEQ ID NO: 121717 - DNA, 1067 bp, Homo sapiens
  Payload ID: 3864
  Gene Symbol: COMMD4
  Gene Name: COMM domain containing 4
  Uniprot ID: Q9H0A8
  ENST ID: ENST00000267935
  CDS Start-End: 200-799
agggaaggattctgggagacggaggaggagacgccagcatttcgccccctgcacctccagcgggctgcggtccgctcccggcctcactcgagcaggccccgccctcccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 121718 - DNA, 722 bp, Homo sapiens
  Payload ID: 3864
  Gene Symbol: COMMD4
  Gene Name: COMM domain containing 4
  Uniprot ID: Q9H0A8
  ENST ID: ENST00000338995
  CDS Start-End: 32-454
agaaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa
